(12) United States Patent
Cameron et al.

(10) Patent No.: US 10,501,524 B2
(45) Date of Patent: Dec. 10, 2019

(54) ALBUMIN VARIANTS

(71) Applicant: Albumedix Ltd, Nottingham (GB)

(72) Inventors: Jason Cameron, Nottingham (GB); Karen Ann Delahay, Nottingham (GB); Jens Erik Nielsen, Bagsvaerd (DK); Andrew Plumridge, Nottingham (GB); Jan Terje Andersen, Oslo (NO)

(73) Assignee: ALBUMEDIX LTD, Nottingham (GB)

( * ) Notice: Subject to any disclaimer, the term of this patent is extended or adjusted under 35 U.S.C. 154(b) by 761 days.

(21) Appl. No.: 14/685,112

(22) Filed: Apr. 13, 2015

(65) Prior Publication Data

US 2015/0210752 A1   Jul. 30, 2015

Related U.S. Application Data

(62) Division of application No. 14/075,104, filed on Nov. 8, 2013, now abandoned.

(60) Provisional application No. 61/724,669, filed on Nov. 9, 2012.

(30) Foreign Application Priority Data

Nov. 8, 2012 (EP) .................................... 12191856

(51) Int. Cl.
| | | |
|---|---|---|
| A61K 38/38 | (2006.01) | |
| C07K 14/76 | (2006.01) | |
| C07K 1/00 | (2006.01) | |
| C07K 14/00 | (2006.01) | |
| C07K 16/00 | (2006.01) | |
| C07K 17/00 | (2006.01) | |
| C07K 14/765 | (2006.01) | |
| A61K 39/385 | (2006.01) | |

(52) U.S. Cl.
CPC .......... *C07K 14/765* (2013.01); *A61K 39/385* (2013.01); *A61K 38/385* (2013.01); *C07K 2319/00* (2013.01); *C07K 2319/31* (2013.01)

(58) Field of Classification Search
CPC ...... C07K 14/76; C07K 14/765; A61K 38/38; A61K 38/385
See application file for complete search history.

(56) References Cited

U.S. PATENT DOCUMENTS

| | | |
|---|---|---|
| 2,714,586 A | 8/1955 | Lynch et al. |
| 4,302,386 A | 11/1981 | Stevens |
| 4,741,900 A | 5/1988 | Alvarez et al. |
| 4,757,006 A | 7/1988 | Toole, Jr. et al. |
| 4,784,950 A | 11/1988 | Hagen et al. |
| 4,795,805 A | 1/1989 | Itoh et al. |
| 4,868,112 A | 9/1989 | Toole, Jr. |
| 5,073,627 A | 12/1991 | Curtis et al. |
| 5,208,020 A | 5/1993 | Chari et al. |
| 5,223,409 A | 6/1993 | Ladner et al. |
| 5,264,586 A | 11/1993 | Nicolaou et al. |
| 5,294,699 A | 3/1994 | Ohmura et al. |
| 5,380,712 A | 1/1995 | Ballance et al. |
| 5,625,041 A | 4/1997 | Johnson et al. |
| 5,698,426 A | 12/1997 | Huse |
| 5,712,374 A | 1/1998 | Kuntsmann et al. |
| 5,714,377 A | 2/1998 | Tanner et al. |
| 5,714,586 A | 2/1998 | Kunstmann et al. |
| 5,716,808 A | 2/1998 | Raymond |
| 5,728,553 A | 3/1998 | Goodey et al. |
| 5,736,383 A | 4/1998 | Raymond |
| 5,766,883 A | 6/1998 | Ballance et al. |
| 5,773,001 A | 6/1998 | Hamann et al. |
| 5,824,837 A | 10/1998 | Chen et al. |
| 5,854,039 A | 12/1998 | Raymond et al. |
| 5,876,969 A | 3/1999 | Fleer et al. |
| 5,888,768 A | 3/1999 | Raymond |
| 5,948,609 A | 9/1999 | Carter et al. |
| 6,509,313 B1 | 1/2003 | Smith |
| 6,599,873 B1 | 7/2003 | Sommer et al. |
| 6,686,179 B2 | 2/2004 | Fleer et al. |
| 6,905,688 B2 | 6/2005 | Rosen et al. |
| 6,926,898 B2 | 8/2005 | Rosen et al. |
| 6,949,691 B2 | 9/2005 | Carter |
| 6,972,322 B2 | 12/2005 | Fleer et al. |
| 6,987,006 B2 | 1/2006 | Fleer et al. |
| 6,989,365 B2 | 1/2006 | Fleer et al. |
| 6,994,857 B2 | 2/2006 | Rosen et al. |

(Continued)

FOREIGN PATENT DOCUMENTS

| | | |
|---|---|---|
| CA | 2611540 | 5/2009 |
| CA | 2562249 | 4/2016 |

(Continued)

OTHER PUBLICATIONS

Andersen et al., 2007, A receptor-mediated mechanism to support clinical observation of altered albumin variants, Clinic Chem, 53(12):2216.

Andersen et al., 2008, Ligand binding and antigenic properties of a human neonatal Fc receptor with mutation of two unpaired cysteine residues, FEBS Journal, 275(16):4097-4110.

Andersen et al., 2009, The versatile MCH class I-related FcRn protects IgG and albumin from degradation: implications for development of new diagnostics and therapeutics, Drug Metab Pharmacokinet, 24(4):318-332.

Andersen et al., Aug. 16, 2013, Single-chain variable fragment albumin fusions bind the neonatal Fc receptor (FcRn) in a species-dependent manner: implications for in vivo half-life evaluation of albumin fusion therapeutics, J Biol Chem., 288(33):24277-85.

(Continued)

*Primary Examiner* — James H Alstrum-Acevedo
*Assistant Examiner* — Zachary J Miknis
(74) *Attorney, Agent, or Firm* — Knobbe, Martens, Olson & Bear LLP

(57) ABSTRACT

The present invention relates to variants of a parent albumin, the variants having altered plasma half-life compared with the parent albumin. The present invention also relates to polynucleotides encoding the variants; nucleic acid constructs, vectors, and host cells comprising the polynucleotides; and methods of using the variants.

25 Claims, 8 Drawing Sheets
(1 of 8 Drawing Sheet(s) Filed in Color)
Specification includes a Sequence Listing.

(56) References Cited

U.S. PATENT DOCUMENTS

| | | |
|---|---|---|
| 7,041,478 B2 | 5/2006 | Fleer et al. |
| 7,041,802 B2 | 5/2006 | Young et al. |
| 7,041,803 B2 | 5/2006 | Ni et al. |
| 7,045,318 B2 | 5/2006 | Ballance |
| 7,053,190 B2 | 5/2006 | Ruben et al. |
| 7,056,701 B2 | 6/2006 | Fleer et al. |
| 7,081,354 B2 | 7/2006 | Fleer et al. |
| 7,094,577 B2 | 8/2006 | Fleer et al. |
| 7,095,577 B1 | 8/2006 | Codilian et al. |
| 7,141,547 B2 | 11/2006 | Rosen et al. |
| 7,196,164 B2 | 3/2007 | Rosen et al. |
| 7,253,259 B2 | 8/2007 | Otagiri |
| 7,271,149 B2 | 9/2007 | Glaesner et al. |
| 7,358,416 B2 | 4/2008 | Roopenian |
| 7,410,779 B2 | 8/2008 | Fleer et al. |
| 7,425,622 B2 | 9/2008 | Rosen |
| 7,435,410 B2 | 10/2008 | Fleer et al. |
| 7,465,707 B2 | 12/2008 | Ni et al. |
| 7,482,013 B2 | 1/2009 | Ballance et al. |
| 7,507,413 B2 | 3/2009 | Rosen et al. |
| 7,507,414 B2 | 3/2009 | Rosen et al. |
| 7,514,079 B2 | 4/2009 | Rosen et al. |
| 7,550,432 B2 | 6/2009 | Ballance |
| 7,569,215 B2 | 8/2009 | Wittrup et al. |
| 7,572,619 B2 | 8/2009 | Hauser et al. |
| 7,592,010 B2 | 9/2009 | Rosen et al. |
| 7,597,886 B2 | 10/2009 | Yu et al. |
| 7,615,537 B2 | 11/2009 | Sea ria et al. |
| 7,785,599 B2 | 8/2010 | Ballance et al. |
| 7,833,521 B2 | 11/2010 | Fleer et al. |
| 7,850,963 B2 | 12/2010 | Rosen et al. |
| 7,851,596 B2 | 12/2010 | Gentz et al. |
| 7,862,818 B2 | 1/2011 | Reschke et al. |
| 7,951,360 B2 | 5/2011 | Wittrup et al. |
| 7,998,691 B2 | 8/2011 | Kulaksiz et al. |
| 8,012,464 B2 | 9/2011 | Rosen et al. |
| 8,080,651 B2 | 12/2011 | Goldberg |
| 8,697,650 B2 | 4/2014 | Gao et al. |
| 8,748,380 B2 | 6/2014 | Plumridge et al. |
| 8,822,417 B2 | 9/2014 | Andersen et al. |
| 9,944,691 B2 | 4/2018 | Delahay |
| 2002/0123080 A1 | 9/2002 | Sonnenschein et al. |
| 2002/0151011 A1 | 10/2002 | Fleer et al. |
| 2003/0091565 A1 | 5/2003 | Beltzer et al. |
| 2003/0104578 A1 | 6/2003 | Ballance |
| 2004/0063635 A1 | 4/2004 | Yu |
| 2004/0171154 A1 | 9/2004 | Storici et al. |
| 2005/0142106 A1 | 6/2005 | Wittrup et al. |
| 2005/0222026 A1 | 10/2005 | Otagiri |
| 2005/0256303 A1 | 11/2005 | Otagiri et al. |
| 2006/0018859 A1 | 1/2006 | Carter |
| 2006/0051859 A1 | 3/2006 | Fu |
| 2006/0171892 A1 | 8/2006 | Woodrow |
| 2006/0178301 A1 | 8/2006 | Jurs |
| 2007/0041987 A1 | 2/2007 | Carter et al. |
| 2007/0092940 A1 | 4/2007 | Eigenbrot |
| 2008/0108560 A1 | 5/2008 | Beals et al. |
| 2008/0167238 A1 | 7/2008 | Rosen et al. |
| 2009/0029914 A1 | 1/2009 | Rosen et al. |
| 2010/0129846 A1 | 5/2010 | Goldknopf |
| 2011/0091412 A1 | 4/2011 | Wittrup et al. |
| 2011/0151490 A1 | 6/2011 | Hillman |
| 2011/0172398 A1 | 7/2011 | Borges et al. |
| 2011/0313133 A1 | 12/2011 | Finnis |
| 2012/0220530 A1 | 8/2012 | Plumridge |
| 2012/0322739 A1* | 12/2012 | Andersen ............ C07K 14/765 514/15.2 |
| 2013/0028930 A1 | 1/2013 | Plumridge |
| 2013/0053322 A1 | 2/2013 | Gao |
| 2013/0225496 A1 | 8/2013 | Plumridge |
| 2014/0128326 A1 | 5/2014 | Cameron |
| 2014/0148392 A1 | 5/2014 | Gao et al. |
| 2014/0234311 A1 | 8/2014 | Sleep et al. |
| 2014/0248682 A1 | 9/2014 | Gao et al. |
| 2014/0315816 A1 | 10/2014 | Andersen et al. |
| 2014/0315817 A1 | 10/2014 | Schmidt et al. |
| 2015/0210752 A1 | 7/2015 | Cameron |
| 2016/0009787 A1 | 1/2016 | Sleep et al. |
| 2016/0033523 A1 | 2/2016 | Cameron et al. |
| 2016/0075756 A1 | 3/2016 | Sleep et al. |
| 2016/0075757 A1 | 3/2016 | Sleep et al. |
| 2016/0075758 A1 | 3/2016 | Sleep et al. |
| 2016/0075759 A1 | 3/2016 | Sleep et al. |
| 2016/0075760 A1 | 3/2016 | Sleep et al. |
| 2016/0075761 A1 | 3/2016 | Sleep et al. |
| 2016/0075762 A1 | 3/2016 | Sleep et al. |
| 2016/0075763 A1 | 3/2016 | Sleep et al. |
| 2017/0081389 A1 | 3/2017 | Finnis et al. |
| 2018/0072792 A1 | 3/2018 | Sleep et al. |
| 2018/0105576 A1 | 4/2018 | Sleep et al. |
| 2018/0105577 A1 | 4/2018 | Sleep et al. |
| 2018/0105578 A1 | 4/2018 | Sleep et al. |
| 2018/0162925 A1 | 6/2018 | Sleep et al. |
| 2018/0222963 A1 | 8/2018 | Sleep et al. |
| 2018/0265569 A1 | 9/2018 | Delahay |
| 2018/0265570 A1 | 9/2018 | Sleep et al. |
| 2018/0334491 A1 | 11/2018 | Schmidt et al. |

FOREIGN PATENT DOCUMENTS

| | | |
|---|---|---|
| CN | 1405182 | 3/2003 |
| CN | 101875693 B | 7/2012 |
| EP | 0 286 424 | 10/1988 |
| EP | 0319067 | 6/1989 |
| EP | 0 413 622 | 2/1991 |
| EP | 0438102 | 7/1991 |
| EP | 0 510 693 | 4/1992 |
| EP | 0 305 216 | 8/1995 |
| EP | 1 681 304 | 7/2006 |
| JP | 2005-206577 | 8/2005 |
| JP | 4983148 | 7/2012 |
| KR | 2005-0075134 | 7/2005 |
| RU | 2369404 | 10/2009 |
| WO | WO 90/13653 | 11/1990 |
| WO | WO 1991/09125 | 6/1991 |
| WO | WO 93/21232 | 10/1993 |
| WO | WO 94/11026 | 5/1994 |
| WO | WO 1995/17413 | 6/1995 |
| WO | WO 1995/22625 | 8/1995 |
| WO | WO 95/23857 | 9/1995 |
| WO | WO 1995/24427 | 9/1995 |
| WO | WO 97/24445 | 7/1997 |
| WO | WO 99/28348 | 6/1999 |
| WO | WO 00/008207 | 2/2000 |
| WO | WO 00/44772 | 8/2000 |
| WO | 00/69902 A1 | 11/2000 |
| WO | WO 2000/071079 | 11/2000 |
| WO | 01/79271 A1 | 10/2001 |
| WO | WO 01/79258 | 10/2001 |
| WO | WO 01/79442 | 10/2001 |
| WO | WO 01/79443 | 10/2001 |
| WO | WO 01/79444 | 10/2001 |
| WO | WO 01/79480 | 10/2001 |
| WO | WO 2002/022809 | 3/2002 |
| WO | WO 02/43658 | 6/2002 |
| WO | WO 02/083897 | 10/2002 |
| WO | WO 02/102830 | 12/2002 |
| WO | 03/059934 A2 | 7/2003 |
| WO | WO 03/060071 | 7/2003 |
| WO | WO 03/066085 | 8/2003 |
| WO | WO 03/066824 | 8/2003 |
| WO | WO 2004/101620 | 1/2004 |
| WO | WO 04/011499 | 2/2004 |
| WO | WO 04/082640 | 9/2004 |
| WO | WO 04/083245 | 9/2004 |
| WO | WO 05/003296 | 1/2005 |
| WO | WO 05/061718 | 7/2005 |
| WO | WO 05/061719 | 7/2005 |
| WO | WO 05/077042 | 8/2005 |
| WO | WO 2005/082423 | 9/2005 |
| WO | WO 06/066595 | 6/2006 |
| WO | WO 06/067511 | 6/2006 |
| WO | WO 06/073195 | 7/2006 |
| WO | WO 2006/118772 | 11/2006 |

(56) References Cited

FOREIGN PATENT DOCUMENTS

| | | |
|---|---|---|
| WO | WO 2006/136831 | 12/2006 |
| WO | WO 07/021494 | 2/2007 |
| WO | WO 07/071068 | 6/2007 |
| WO | WO 2007/090584 | 8/2007 |
| WO | WO 07/112940 | 10/2007 |
| WO | WO 07/146038 | 12/2007 |
| WO | WO 2007/144173 | 12/2007 |
| WO | WO 2008/007146 | 1/2008 |
| WO | WO 08/030558 | 3/2008 |
| WO | WO 09/019314 | 2/2009 |
| WO | WO 2009/081201 | 7/2009 |
| WO | WO 09/126920 | 10/2009 |
| WO | WO 09/134808 | 11/2009 |
| WO | WO 10/059315 | 5/2010 |
| WO | WO 10/065950 | 6/2010 |
| WO | WO 10/068278 | 6/2010 |
| WO | 2010/092135 A2 | 8/2010 |
| WO | 2010/118169 A2 | 10/2010 |
| WO | WO 10/118169 | 10/2010 |
| WO | WO 10/129023 | 11/2010 |
| WO | WO 10/138814 | 12/2010 |
| WO | WO 10/141329 | 12/2010 |
| WO | WO 11/011315 | 1/2011 |
| WO | WO 11/011797 | 1/2011 |
| WO | WO 2011/018611 | 2/2011 |
| WO | WO 11/044563 | 4/2011 |
| WO | 2011/051489 A2 | 5/2011 | |
| WO | WO-2011051489 A2 * | 5/2011 | ........... C07K 14/765 |
| WO | WO 11/079175 | 6/2011 |
| WO | 2011/103076 A1 | 8/2011 |
| WO | 2011/124718 A1 | 10/2011 |
| WO | WO 11/146902 | 11/2011 |
| WO | WO 11/161127 | 12/2011 |
| WO | WO 2012/020143 | 2/2012 |
| WO | 2012/059486 A1 | 5/2012 |
| WO | 2012/112188 A1 | 8/2012 |
| WO | 2012/150319 A1 | 11/2012 |
| WO | WO 13/010840 | 1/2013 |
| WO | WO 13/075066 | 5/2013 |
| WO | WO 13/135896 | 9/2013 |
| WO | WO 14/005596 | 1/2014 |
| WO | WO 14/036508 | 3/2014 |
| WO | 2014/072481 A1 | 5/2014 |
| WO | WO 14/179657 | 11/2014 |
| WO | WO 2015/036579 | 3/2015 |

OTHER PUBLICATIONS

Andersen et al., May 2014, Extending serum half-life of albumin by engineering neonatal Fc receptor (FcRn) binding, J Biol Chem., 289(19):13492-502.

Anderson et al., 2006, Perspective—FcRn transports albumin: relevance to immunology and medicine, Trends Immunol, 27(7):343-348.

Balan et al., 2006, A phase I/II study evaluating escalating doses of recombinant human albumin-interferon-α fusion protein in chronic hepatitis C patients who have failed previous interferon-α-based therapy, Antiviral Therapy, 11(1):35-45.

Ballesta-Claver et al., 2011, Disposable luminol copolymer-based biosensor for uric acid in urine, Analytica Chimica Acta, 702:254-261.

Barash et al., 1993, Synthesis and secretion of human serum albumin by mammary gland explants of virgin and lactating transgenic mice, Trans Res, 2:266-276.

Bar-Or et al., 2006, The formation and rapid clearance of a truncated albumin species in a critically ill patient, Clin Chim Acta 365(1-2):346-349.

Barr et al., 1996, C-Type Natriuretic Peptide, Peptides 17:1243-1251.

Benotti et al., 1979, Protein and caloric or macronutrient metabolic management of the critically ill patient, Crit Care Med, 7(12):520-525.

Bergman et al., Jun. 2012, Development of a mathematical model for neonatal Rc receptor recycling to design human serum albumin mutants with extended half-lives, Medimmune FcRn recycling model for mutant albumins, poster, $21^{st}$ PAGE meeting, Venice Italy, 1 p.

Berntzen et al., 2005, Prolonged and increased expression of soluble FC receptors, IgG and a TCR-Ig fusion protein by transiently transfected adherent 293E cells, J Immun Method, 298:93-104.

Bhattacharya et al., 2000, Binding of the general anesthetics propofol and halothane to human serum albumin. High resolution crystal structures, J. Biol. Chem., 275(49):38731-38738.

Bhattacharya et al., 2000, Crystallographic analysis reveals common modes of binding of medium and long-chain fatty acids to human serum albumin, J. Mol. Biol., 303:721-732.

Blackburn, 2007, Maternal, Fetal and Neonatal Physiology: a Clinical Perspective, 3rd ed., pp. 197-198.

Bosse et al., 2005, Phase I comparability of recombinant human albumin and human serum albumin, J Clin Pharmacol, 35:57-67.

Bowe et al., 2001, FGF-23 inhibits renal tubular phosphate transport and is a PHEX substrate, Biochem. Biophys. Res. Commun., 284:977-981.

Brennan et al., 2000, Three truncated forms of serum albumin associated with pancreatic pseudocyst, Biochim Biophys Acta 1481(2):337-343.

Broze et al., Feb. 25, 1980, Purification and properties of human coagulation factor VII, The Journal of Biological Chemistry, 255(4):1242-1247.

Bunting et al., 2012, Enhanced albumins and albumin fusion technology: tuning circulatory half-life with Novozymes Albufuse® Flex to meet medical needs, Poster, Biopharma NZ, 1 p.

Burmeister et al., 1994, Crystal structure at 2.2 Å result ion of the MHC-related neonatal Fc receptor, Nature, 372(6504):336-343.

Burmeister et al., 1994, Crystal structure of the complex of rat neonatal Fc receptor with Fc, Nature, 372(6504):379-383.

Cai et al., Jun. 2010, QPSOBT: One codon usage optimization software for protein heterologous expression, J Bioinformatics Sequence Analysis, 2(2):25-29.

Cantor et al., 1980, Box 21-2. Reoxidation and refolding of reduced proteins. Biophysical chemistry. Part III: The behavior of biological macromolecules, p. 1104.

Carter et al., 1989, Three dimensional structure of human serum albumin, Science, 244(4909):1195-1198.

Chari et al., 1992, Immunoconjugates Containing Novel Maytansinoids: Promising Anticancer Drugs Cancer Research 52:127-131.

Chaudhury et al., 2003, The major histocompatibility complex-related Fc receptor for IgG (Fern) binds albumin and prolongs its lifespan, J Exp Med, 197(3):315-322.

Chaudhury et al., Apr. 18, 2006, Albumin binding to FcRn: distinct from the FcRn-IgG interaction, Biochemistry, 45:4983-4990.

Chen et al., 2003, ZDOCK: an initial-stage protein-docking algorithm, Protein, 52:80-87.

Condreay et al., 2007, Baculovirus Expression Vectors for Insect and Mammalian Cells, Current Drug Targets, 8:1126-1131.

Cornell et al., 1981, The environment of the sulfhydryl group in human plasma albumin as determined by spin labelling, Arch Biochem Biophys, 209(1):1-6.

Cronican et al., 2010—Geneseq, Access No. AXS56687.

Crystal Structure of Human Serum Albumin AT 2.5 A Resolution, PDB Accession: 1A06. publically available in 1999, 125 pp.

Curry et al., 1998, Crystal structure of human serum albumin complexed with fatty acid reveals on asymmetric distribution of binding sites, Nat Struct Biol, 5(9):827-835.

Dagnino et al., 2010, A novel frameshift deletion in the albumin gene causes analbuminemia in a young Turkish woman, Clinic Chimica Acta, 411:1711-1715.

Database NCBI—Access No. 1A06_A (Jun. 1998).
Database NCBI—Access No. AAC63407 (Oct. 1998).
Database NCBI—Access No. AAD09358 (Jan. 1999).
Database NCBI—Access No. AAL08579 (Sep. 2001).
Database NCBI—Access No. AAL56646 (Jan. 2002).
Database NCBI—Access No. AAM46104 (Jun. 2002).
Database NCBI—Access No. AAQ20088 (May 2004).
Database NCBI—Access No. ACF10391 (Jul. 2008).

(56) References Cited

OTHER PUBLICATIONS

Database NCBI—Access No. NP_001004887 (Feb. 2011).
Database NCBI—Access No. NP_001127106 (May 2011).
Database NCBI—Access No. P02768 (Apr. 2011).
Database NCBI—Access No. P02770 (May 2011).
Database NCBI—Access No. P07724 (May 2011).
Database NCBI—Access No. P21847 (Nov. 2010).
Database NCBI—Access No. P21848 (May 2011).
Database NCBI—Access No. P35747 (May 2011).
Database NCBI—Access No. P83517 (May 2011).
Database NCBI—Access No. Q03156 (May 2011).
Database NCBI—Access No. Q6WDN9-1 (Nov. 2006).
Database NCBI—Access No. Q91274 (Aug. 2010).
Database NCBI—Access No. QXLE4 (May 2011).
Database NCBI—Access No. S59517 (Mar. 2000).
Database Swiss prot—Access No. P49822 (Jun. 2009).
Database Swissprot—Access No. O73860 (Jun. 2009).
Database Swissprot—Access No. P01012 (Jun. 2009).
Database Swissprot—Access No. P02768 (May 2009).
Database Swissprot—Access No. P02769 (Jun. 2009).
Database Swissprot—Access No. P08835 (May 2009).
Database Swissprot—Access No. P14639 (May 2009).
Database Swissprot—Access No. P19121 (Jun. 2009).
Database Swissprot—Access No. P49064 (May 2009).
Database Swissprot—Access No. P49065 (May 2009).
Database Swissprot≠Access No. Q28522 (May 2009).
DeMarco et al., 2007, Schistosome albumin is of host, not parasite, origin, Int J Parasit., 37(11):2101-1208.
Di Stefano et al., 2004, A novel method for coupling doxorubicin to lactosaminated human albumin by an acid sensitive hydrazone bond; synthesis, characterization and preliminary biological properties of the conjugate, Eur J Pharm Sci, 23:393-397.
Dickinson et al., Oct. 1999, Bidirectional FcRn-dependent IgG transport in a polarized human intestinal epithelial cell line, J Clin Invest., 104(7):903-911.
Dockal et al., Oct. 1, 1999, The three recombinant domains of human serum albumin, J Biol Chem, 274(41):29303-29310.
Doronina et al., 2003, Development of potent monoclonal antibody auristatin conjugates for cancer therapy, Nat Biotechnol, 21:778-784.
Elble, 1992, A simple and efficient procedure for transformation of yeasts, Biotechniques 13(1):18-20.
Farran et al., 2002, Targeted expression of human serum albumin to potato tubers, Trans Res, 11:337-346.
Feng et al., 2011, Design, expression and characterization of a soluble single-chain functional human neonatal Fc receptor, Protein Expression and Purification, 79:66-71.
Ferrara et al., 1999, Pathophysiologic mechanisms of acute graft-vs.-host disease, Biology of Blood and Marrow Transplantation, 5:347-56.
Flanagan, Jun. 15, 2009, Protein engineering reaches new frontiers: more detailed knowledge of structure and function drives field forward quickly, Gen Eng Biotech News, 11(12):1-4.
Fleer et al., Oct. 1991, Stable multicopy vestors for high-level secretion of recombinant human serum albumin by kluyveromyces yeasts, Biotech, 9:968-975.
Francisco et al., Aug. 2003, cAC10-vcMMAE, an anti-CD30-monomethyl auristatin E conjugate with potent and selective anti-tumor activity, Blood, 102(4):1458-1465.
Fu et al., 2004, Fibroblast growth factor 19 increases metabolic rate and reverses dietary and leptin-deficient diabetes. Endocrinology. 145:2594-2603.
Galliano et al., 1986, Structural characterization of a chain termination mutant of human serum albumin, J. Biol. Chem., 261:4283-4287.
Gao et al., 2004, UpGene: Application of a Web-Based DNA Codon Optimization Algorithm, Biotechnol Prog, 20:443-448.
Garnier et al., 1994, Scale-Up of the Adenovirus Expression System for the Production of Recombinant Protein in Human 293S Cells, Cytotechnology, 15:145-155.
Gibbs et al., Apr. 13, 2007, Evolutionary and biomedical insights from the Rhesus Macaque genome, Science, 316(5822):222-234.
Graf et al., 2000, Concerted Action of Multiple cis-Acting Sequences Is Required for Rev Dependence of Late Human Immunodeficiency Virus Type 1 Gene Expression, J Virol 74:10822-10826.
Grantham et al., 1980, Codon Frequencies in 119 Individual Genes Confirm Consistent Choices of Degenerate Bases According to Genome Type, Nuc. Acids Res. 8(9):1893-1912.
Grosjean et al., 1982, Preferential Codon Usage in Prokaryotic Genes; The Optimal Codon-Anticodon Interaction Energy and the Selective Codon Usage in Efficiently Expressed Genes, Gene, 18:199-209.
Gustafsson et al., 2004, Codon bias and heterologous protein expression, Trends in Biotechnol. 22:346-353.
Gutniak et al., 1992, Antidiabetogenic Effect of Glucagon-like Peptide-1 (7-36) amide in Normal Subjects and Patients with Diabetes Mellitus N Engl J Med 326:1316-1322.
Haas et al., 1996, Codon usage limitation in the expression of HIV-1 envelope glycoprotein, Curr. Biol. 6:315-324.
Hagen et al., 1986, Characterization of a cDNA coding for human factor VII, Proc. Natl. Acad. Sci. USA, 83:2412-2416.
Hall et al., 2012, Interspecies scaling in pharmacokinetics: a novel whole-body physiologically based modeling framework to discovery drug biodistribution mechanisms In Vivo, J Pharma Sci, 101:1221 1241.
Hallstrom et al., 2008, S-nitroso human serum albumin reduces ischaemia/reperfusion in jury in the pig heart after unprotected warm ischaemia, Cardiovascular Res, 77:506-514.
Haspel et al., 1999, Effects of barbiturates on facilitative glucose transporters are pharmacologically specific and isoform selective, J Membr Biol, 169:45-53.
Hassan et al., Oct. 1997, All About Albumin, Review, Clin Chem 43(10):2014a-2015.
Hay et al., Apr. 9, 2009, ThioTransferrin: a recombinant human transferrin engineered fir site specific drug conjugation and delivery, Oral Presentation, 5th Annual PEGS, Boston, MA, 22 pp.
Henrotte et al., 2004, Investigation of non-covalent interactions between paramagnetic complexes and human serum albumin by electrospray mass spectrometry, Rapid Comm Mass Spectra, 18:1919-1924.
Herzog et al., 1999, long-term correction of canine hemophilia B by gene transfer of blood coagulation factor IX mediated by adena-associated viral vector, Nature Medicine, 5(1):56-63.
Hillier et al, Apr. 2007, Generation and annotation of the DNA sequences of human chromosomes 2 and 4, Nature, 434:724-731.
Hinman et al., 1993, Preparation and Characterization of Monoclonal Antibody Conjugates of the Calicheamicins: A Novel and Potent Family of Antitumor Antibiotics, Cancer Research 53:3336-3342.
Holm, 1986, Codon usage and gene expression, Nuc. Acids Res. 14:3075-3087.
Holt et al., 2003, Definition of a novel growth factor-dependent signal cascade for the suppression of bile acid biosynthesis, Genes Dev, 17:1581-1591.
Houghton et al., 1980, The complete amino acid sequence of human fibroblast interferon as deduced using synthetic oligodeoxyribonucleotide primers of reverse transcriptase, Nucleic Acids Res., 8(13):2885-2894.
Howard et al., 1989, Intracerebral Drug Delivery in Rats with Lesion-Induced Memory Deficits, J. Neurosurg. 71:105-112.
Huang et al., Sep. 2002, serum albumin [*Homo sapiens*] GenBank: AAN17825.1, http://www/ncbi/nlm.nih.gov/protien/aan17825.
Ikemura, 1987, Correlation between the abundance of yeast transfer RNAs and the occurrence of the respective codons in protein genes. Differences in synonymous codon choice patterns of yeast and *Escherichia coli* with reference to the abundance of isoaccepting transfer RNAs J. Mol. Biol. 158:573-597.
Ishima et al., 2007, S-nitrosylation of human variant albumin liprizzi (R410C) confers potent antibacterial and cytoprotective properties, J Pharma Exp Therapeutics, 320(3):969-977.
Ito et al., 1983, Transformation of intact yeast cells treated with alkali cations, J Bacterial, 153(1):163-168.
Iwao et al., 2006, Oxidation of Arg-410 promotes the elimination of human serum albumin, Biochim Biophys Acta, 1764(4):743-749.

(56) References Cited

OTHER PUBLICATIONS

Iwao et al., 2009, Altered chain-length and glycosylation modify the pharmacokinetics of human serum albumin, Biochem Biophys Acta, 1794(4):634-641.
Jaye et al., 1983, Isolation of a human anti-haemophilic factor IX cDNA clone using a unique 52-base synthetic oligonucleotide probe deduced from the amino acid sequence of bovine factor IX, Nucleic Acids Res. 11(8):2325-2335.
Jerdeva et al., Comparison of FcRn- and pIgR-mediated transport in MOCK cells by fluorescence confocal microscopy. Traffic. Sep. 2010;11 (9):1205-20.
Kabsch et al., 1983, Dictionary of protein secondary structure: pattern recognition of hydrogen-bonded and geometrical features, Biopolymers, 22(12):2577-2637.
Kaneko et al., Jan. 2008, Subdomain IIIA of dog albumin contains a binding site similar to site II of human albumin, Drug Megab. Disposition 36:81-86.
Kenanova et al., 2005, Tailoring the pharmacokinetics and positron emission tomography imaging properties of anti-carcinoembryonic antigen single-chain Fv-Fc antibody fragments, Cancer Res, 65(2):622-631.
Kenanova et al., 2007, Radioiodinated versus radiometal-labeled anti-carcinoembryonic antigen single-chain Fv-Fc antibody fragments; optimal pharmacokinetics for therapy, Cancer Res, 67(2):718-726.
Khan et al., 2002, Bilirubin binding properties of pigeon serum albumin and its comparison with human serum albumin, J Biol Macromol., 30(3-4):171-178.
Kharitonenkov et al., 2005, FGF-21 as a novel metabolic regulator, J. Clin. Invest., 115(6):1627-1635.
Kim et al., Mar. 2003, Development and characterization of a glucagon-like peptide 1-albumin conjugate: the ability to activate the glucagon-like peptide 1 receptor in vivo, Diabetes, 52:751-759.
Kobayashi et al., 1998, The development of recombinant human serum albumin, Thera Apheresis, 2:257-262.
Kragh-Hansen et al., 2002, Practical aspects of the ligand-binding and enzymatic properties of human serum albumin, Biol Pharm Bull, 25(6):695-704.
Kragh-Hansen et al., 2004, Structural analysis and fatty acid-binding properties of two Croatian variants of human serum albumin, Clinical Chimica Acta, 349:105-112.
Kragh-Hansen et al., 2005, Effect of genetic variation on the thermal stability of human serum albumin, Biochim Biophys Acta, 1747(1):81-88.
Kuo et al., 2010, Neonatal Fc receptor: from immunity to therapeutics, J Clin Immunol, 30(6):777-789.
Kurtzhals et al., 1997, Effect of fatty acids and selected drugs on the albumin binding of a long-acting, acylated insulin analogue, J Pharma Sci, 86:1365-1368.
Laftah et al., May 15, 2004, Effect of hepcidin on intestinal iron absorption in mice, Blood, 103(10):3940-3944.
Larsen et al., 2004, Use of the Gottingen minipig as a model of diabetes, with special focus on type 1 diabetes research ILAR Journal, 45(3):303-313.
Leger et al., 2004, Identification of CJC-1131-albumin bioconjugate as a stable and bioactive GLP-1(7-36) analog, Bioorg Med Chem Lttrs, 14:4395-4398.
Leger et al., 2003, Synthesis and in vitro analysis of atrial natriuretic peptide-albumin conjugates, Bioorganic Medical Chem Lttrs, 13:3571-3575.
Li et al., 2001, Bipartite regulation of different components of the MHC class 1 antigen-processing machinery during dendritic cell maturation, Intl Immunol, 13(12):1515-1523.
Liu et al., 2009, A high-yield and scaleable adenovirus vector production process based on high density perfusion culture of HEK 293 cells as suspended aggregates, J. Bioscience and Bioengineering, 107:524-529.
Lode et al., Jul. 15, 1998, Targeted Therapy with a Novel Enediyene Antibiotic Calicheamicin theta11 Effectively Suppresses Growth and Dissemination of Liver Metastases in a Syngeneic Model of Murine Neuroblastoma, Cancer Research, 58:2925-2928.
Luckow et al., 1993, Efficient Generation of Infectious Recombinant Baculoviruses by Site-Specific Transposon-Mediated Insertion of Foreign Genes into a Baculovirus Genome Propagated in *Escherichia coli*, J. Virol. 67:4566-4579.
Mahmood, 2004, Chapter 7: Principles, issues and applications of interspecies scaling, in New Drug Development, Sahajwalla ed., Marcel Dekker, Inc., New York, pp. 137-163.
McClenaghan et al., Aug. 1996, Characterization of a novel glucose-responsive insulin-secreting cell line, BRIN-BD11 ,produced by electrofusion, Diabetes, 45:1132-1140.
McGregor, 2008, Discovering and improving novel peptide therapeutics, Curr Opin Pharmacol, 8(5):616-619.
Mezo et al., 2010, X-ray crystal structures of monomeric and dimeric peptide inhibitors in complex with the human neonatal Fc receptor, FcRn, J Biol Chem, 285(36):27694-27701.
Miguel et al., 2003, Cooperative enhancement of insulinotropic action of GLP-1 by acetylcholine uncovers paradoxical inhibitory effect of beta cell muscarinic receptor activation on adenylate cyclase activity Biochem Pharm., 65:283-292.
Minchiotti et al., 1990, The molecular defect of albumin Castel di Sangro: 536 Lys→Gllu, Biochem Bioph Acta, 1039:204-208.
Minchiotti et al., 2001, A nucleotide insertion and frameshift cause albumin Kenitra, an extended and O-glycosylated mutant of human serum albumin with two additional disulfide bridges, Eur J Biochem, 268:344-352.
Minchiotti et al., 2008, Mutations and polymorphisms of the gene of the major human blood protein, Serum albumin, Human Mutation 29(8):1007-1016.
Montoyo et al., 2009, Conditional deletion of the MHC class 1-related receptor FcRn reveals the sites of IgG homeostasis in mice, Proc Natl Acad Sci USA, 106(8):2788-2793.
Morrissey et al., Feb. 1, 1993, Quantitation of activated factor VII levels in plasma using a tissue factor mutant selectively deficient in promoting factor VII activation, Blood, 81(3):734-744.
Muller et a., 2007, Improved pharmacokinetics of recombinant bispecific antibody molecules by fusion to human serum albumin, J Bio Chem, 282(17):12650-12660.
Nauck et al., 1993, Normalization of fasting hyperglycaemia by exogenous glucagon-like peptide 1 (7-36 amide) in type 2 (non-insulin-dependent) diabetic patients, Diabetologia 36:741-744.
Nauck et al., 1993, Preserved incretin activity of glucagon-like peptide 1 [7-36 amide] but not of synthetic human gastric inhibitory polypeptide in patients with type-2 diabetes mellitus. Clin Invest, 91:301-307.
NCBI Database Access No. 103600-Albumin (2011).
Needleman et al., 1970, A general method applicable to the search for similarities in the amino acid sequence of two proteins J. Mol. Biol., 48(3):443-453.
Nierman et al., 2007, EMBL Access No. AAHF0100013.
New Century Pharmaceuticals Inc., 2005 Catalog, Recombinant Serum Albumin: Other Proteins & Antibodies, pp. 1-36.
Ober et al., 2004, Exocytosis of IgG as medicated by the receptor, FcRn: an analysis at the single-molecule level, Proc Natl Acad Sci USA, 101(30):11076-11081.
Ober et al., 2004, Visualizing the site and dynamics of IgG salvage by the MHC class I-related receptor, FcRn, J Immunol, 172(4):2021-2029.
Oganesyan et al., 2014, Structural insights into neonatal Fc receptor-based recycling mechanisms, J Biol Chem 289(11):7812-24.
O'Hara et al., Aug. 1987, Nucleotide sequence of the gene coding for human factor VII, a vitamin K-dependent protein participating in blood coagulation, PNAS USA, 84:5158-5162.
Olafsen et al., 2006, Tunable pharmacokinetics; modifying the in vivo half-life of antibodies by directed mutagenesis of the Fc fragment, Nature Protocol, 1(4):2048-2060.
O'Neill et al., 2008, Scale-up of Agrobacterium-mediated transient protein expression in bioreactor-grown Nicotiana glutinosa plant cell suspension culture, Biotechnol. Prog. 24:372-376.
Osborn et al., 2002, Pharmacokinetic and pharmacodynamic studies of a human serum albumin-interferon-α fusion protein in cynomolgus monkeys, J Pharmacol Exp Ther, 303(2):540-548.

(56) References Cited

OTHER PUBLICATIONS

Peters, 1985, Serum Albumin, Advances in Protein Chemistry, 17:161-245.
Peters, 1996, All about Albumin: Biochemistry, Genetics and Medical Applications, Academic Press, Cooperstown, NY, pp. 10, 170-181, 245-250.
Pierce, Crosslinking Reagents Technical Handbook, downloaded Feb. 9, 2009, 48 pp.
Pittman et al., 1993, Biochemical, immunological, and in vivo functional characterization of B-domain-deleted factor VIII, Blood, 81:2925-2935.
Prabhat et al., 2007, Elucidation of intracellular recycling pathways leading to exocytosis of the Fc receptor, FcRn, by using multifocal plane microscopy, Proc Natl Acad Sci USA, 104(14):5889-5894.
Rakestraw et al., 2009, Directed evolution of a secretory leader for the improved expression of heterologous proteins and full-length antibodies in *Saccharomyces cerevisiae*, Biotechnology and Bioengineering, 103(6):1192-1201.
Rao et al , 2003, Interleukin-2 mutants with enhanced alpha-receptor subunit binding affinity, Protein. Eng., 16:1081-1087.
Rao et al., 2005, High-affinity CD25-binding IL-2 mutants potently stimulate persistent T cell growth, Biochemistry 44:10696-10701.
Rice et al., 2000, EMBOSS: The European Molecular Biology Open Software Suite, Trends in Genetics, 16(6):276-277.
Riminucci et al., Sep. 2003, FGF-23 in fibrous dysplasia of bone and its relationship to renal phosphate wasting, J Clin Invest, 112(5):683-92.
Rinderknecht et al., Jun. 10, 1984, Natural Human Interferon-gamma. Complete amino acid sequence and determination of sites of glycosylation, J. Biol. Chem., 259(11):6790-6797.
Roopenian et al., 2003, The MHC class I-like IgG receptor controls perinatal IgG transport, IgG homeostasis, and fate of IgG-Fc-coupled drugs, J Immunol, 170(7):3528-3533.
Roopenian et al., 2010, Human FcRn transgenic mice for pharmacokinetic evaluation of therapeutic antibodies, Methods Mol Biol, 602:93-104.
Sabater-Lleal et al., 2006, Human F7 sequence is split into three deep clades that are related to FVII plasma levels, Hum Genet 118:741-751.
Sayle et al. Sep. 1995, RASMOL: biomolecular graphics for all, TIBS 20, 374-377.
Schulte, 2008, Use of albumin fusion technology to prolong the half-life of recombinant factor vlla, Thromb. Res. 122 Suppl. 4:S14-19 (abstract).
Several (definition), dictionary.com, accessed on Oct. 30, 2015, 4 pp.
Sheffield et al., 2000, Modulation of clearance of recombinant serum albumin by either glycosylation or truncation, Thrombosis Research, 99(6):613-621.
Shimada et al., 2004, FGF-23 Is a Potent Regulator of Vitamin D Metabolism and Phosphate Homeostasis, J. Clin. Invest, 19(3):429-435.
Sijmons et al., 1990, Production of correctly process human serum albumin in transgenic plants, Biotech, 8:217-221.
Silveira et al., 1994, Activation of Coagulation Factor VII During Alimentary Lipemia, Arteriosclerosis and Thrombosis, 14:60-69.
Simard et al., 2005, Locating high-affinity fatty acid-binding sites on albumin by x-ray crystallography and NMR spectroscopy, Proc Natl Acad Sci USA, 102(50):17958-17963.
Simard et al., 2006, Location of High and Low Affinity Fatty Acid Binding Sites on Human Serum Albumin Revealed by NMR Drug-competition Analysis, Journal of Molecular Biology, 361:336-351.
Singh et. al., 2008, GASCO: Genetic Algorithm Simulation for Codon Optimization, In Silico Biology 8:187-192.
Sleep et al., 1991, *Saccharomyces cerevisiae* strains that overexpress heterologous proteins, Nature Biotechnol, 9(2):183-187.
Sleep et al., 2001, Yeast 2 μm plasmid copy number is elevated by a mutation in the nuclear gene UBC4, Yeast, 18(5):403-421.
Sleep et al., Jan. 1990, The secretion of human serum albumin from the yeast *Saccharomyces cerevisiae* using five different leader sequences, Biotechnology 8:42-46.
Sleep, 2012, Produce Proteins with Tailored Circulatory Half Life to Meet Patient's Specific Medical Needs, Keynote Address, Drug Delivery Partnerships. Las Vegas, NV. Jan. 25-27, 2012.
Sorensen et al., 2004, Whole blood clot formation phenotypes in hemophilia A and rare coagulation disorders. Patterns of response to recombinant factor Vila J. Thrombosis and Haemostasis 2:102-110.
Spiekermann et al., Receptor-mediated Immunoglobulin G Transport Across Mucosal Barriers in Adult Life J Exp Med. Aug. 5, 2002;196(3):303-10, and correction.
Stehle et al., 1997, Plasma protein (albumin) catabolism by the tumor itself—implications for tumor metabolism and the genesis of cachexia, Crit Rev Oncol Hematol, 26(2):77-100.
Stewart et al., Apr. 1, 2003, Interdomain zinc site on human albumin, Proc Nat Acad Sci USA, 100(7):3701-3706.
Sugio et al., Jun. 1999, Crystal structure of human serum albumin at 2.5 Å resolution, Protein Eng. 12(6):439-446.
Suzuki et al., 2010, Importance of Neonatal FcR in Regulating the Serum Half-Life of Therapeutic Proteins Containing the Fc Domain of Human IgG1: A Comparative Study of the Affinity of Monoclonal Antibodies and Fc-Fusion Proteins to Human Neonatal FcR, The Journal of Immunology, 184:1968-1976.
Sykes et al., May 1, 1994, Interleukin-2 inhibits graft-versus-host disease-promoting activity of CD4+ cells while preserving CD4- and CD8-mediated graft-versus-Leukemia effects, Blood, 83(9):2560-2569.
Tesar et al., Ligand valency affects transcytosis, recycling and intracellular trafficking mediated by the neonatal Fc receptor Traffic. Sep. 2006;7(9):1127-42.
Thibaudeau et al., 2005, Synthesis and evaluation of insulin—human serum albumin conjugates, Biocon Chem, 16(4):1000-1008.
Thim et al., 1988, Amino acid sequence and posttranslational modifications of human factor Vila from plasma and transfected baby hamster kidney cells, Biochemistry, 27:7785-7793.
Toole et al., 1984, Molecular cloning of a cDNA encoding human antihaemophilic factor Nature, 312:342-347.
Tsakiridis et al., 1995, Multiple roles of phosphatidylinositol 3-kinase in regulation of glucose transport, amino acid transport, and glucose transporters in L6 skeletal muscle cells, Endocrinology, 136(10):4315-4322.
Ueda et al., 2009, Chemoenzymatic Synthesis of Glycosylated Glucagon-like Peptide 1: Effect of Glycosylation on Proteolytic Resistance and in Vivo Blood Glucose-Lowering Activity, J. ACS Articles, 131:6237-6245.
Uniprot Database Accession No. F7HCHO, Jul. 27, 2011, 2 pp.
UniProt Database Accession No. A6NBZ8 (A6NBZ8_HUMAN), Version 24, modified Mar. 8, 2011, accessed at http://www.uniprot.org/uniprot/A6NBZ8 on Mar. 23, 2011.
Urso et al., 1999, Differences in signaling properties of the cytoplasmic domains of the insulin receptor and insulin-like growth factor receptor in 3T3-L 1 adipocytes, J Biol Chem, 274:30864-30873.
Van Deijk et al., 1983, Evaluation of a Coagulation Assay Determining the Activity State of Factor VII in Plasma Haemostasis, 13:192-197.
Van der Spoel et al., 2005, GROMACS: fast, flexible, and free, J Comp Chem, 22:1701-1718.
Vestberg et al., 1992, High-affinity binding of warfarin, salicylate and diazepam to natural mutants of human serum albumin modified in the c-terminal end, Biochem Pharmacol, 44(8):1515-1521.
Wain-Hobson et al. 1981, Preferential codon usage in genes, Gene 13:355-364.
Wang et al., 1997, Regulation of glucose transporters and hexose uptake in 3T3-L 1 adipocytes: glucagon-like peptide-1 and insulin interactions, J Mol Endocrinol, 19:241-248.
Wang et al., 2008, Overexpression of fibroblast growth factor 23 suppresses osteoblast differentiation and matrix mineralization in vitro. J Bone Miner Res. 23(6):939-948.

(56) References Cited

OTHER PUBLICATIONS

Wani et al., 2006, Familial hypercatabolic hypoproteinemia caused by deficiency of he neonatal Fc receptor, FcRn, due to a mutant β2-microglobulin gene, Proc Natl Acad Sci USA 103(13):5084-5089.
Ward et al., 2009, Multitasking by exploitation of intracellular transport functions: the many faces of FcRn, Adv Immunol 103:77-115.
Watkins et al., A donor splice mutation and a single-base deletion produce two carboxy-terminal variants of human serum albumin, Proc. Natl. Acad. Sci. 88:5959-5963.
Watkins et al., Mar. 1993, cDNA and protein sequence of polymorphic macaque albumins that differ in bilirubin binding, Proc. Natl. Acad. Sci. USA, 90:2409-2413.
Werle et al., 2006, Strategies to improve plasma half life time of peptide and protein drugs, Amino Acids, 30(4):351-367.
West et al., 2000, Crystal structure and immunoglobulin G binding properties of the human major histocompatibility complex-related Fc receptor, Biochemistry 39(32):9698-9708.
Wildgoose et al., 1992, Measurement of basal levels of factor VIIa in hemophilia A and B patients, Blood, 80:25-28.
Wood et al., 1984, Expression of active human factor VIII from recombinant DNA clones, Nature 312:330-337.
Wu et al., Apr. 5, 1987, Receptor-mediated in vitro gene transformation by a soluble DNA carrier system, J. Biol. Chem., 262(10):4429-4432.
Wu et al., Dec. 1989, Urate Oxidase: Primary Structure and Evolutionary Implications, PNAS USA, 86:9412-9416.
Wunder et al., 2003, Albumin-based drug delivery as novel therapeutic approach for rheumatoid arthritis, The Journal Immunology, 170:4793-4801.
Yoshida et al., Human neonatal Fc receptor mediates transport of IgG into luminal secretions for delivery of antigens to mucosal dendritic cells Immunity. Jun. 2004;20(6):769-83.
Zalevsky et al., Feb. 2010, Enhanced antibody half-life improves in vivo activity, Nature Biotechnology, 28(2):157-159.
Zheng et al., 2012, Minipig as a potential translatable model for monoclonal antibody pharmacokinetics after intravenous and subcutaneous administration, mAbs, 4(2):243-255.
Zhu et al., Calnexin and ERp57 facilitate the assembly of the neonatal Fc receptor for IgG with beta 2-microglobulinin the endoplasmic reticulum J Immunol, Jul. 15, 2005;175(2):967-76.
Zhu et al., MHC class I-related neonatal Fc receptor for IgG is functionally expressed in monocytes, intestinal macrophages, and dendritic cells J Immuno, Mar. 1, 2001;166(5):3266-76.
International Search Report and Written Opinion of International Application No. PCT/US2012/065733, dated May 21, 2013.
International Search Report of PCT/US2014/036508 dated Oct. 9, 2014.
Written Opinion of the International Searching Authority for PCT/US2014/036508 dated Oct. 9, 2014.
International Search Report, International Patent Application No. PCT/IB2014/003002, dated Aug. 12, 2015.
Andersen et al, 2010, Clinical Biochem 43, 367-372.
Andersen et al, 2010, J Biol Chem 285(7), 4826-4836.
Anderson et al, 2006, Eur J Immunol 36, 3044-3051.
Anderson et al, 2010, Nat Commun 3, 610.
Carlson et al, 1992, Proc Natl Acad Sci 89, 8225-8229.
Chaudhury et al, 2006, Biochemistry 45, 4983-4990.
Galliano et al, 1993, Biochim Biophys Acta 1225, 27-32.
Iwao et al, 2007, Biochim Biophys Acta 1774, 1582-1590.
Kenanova et al, 2009, J Nucl Med 50 (Supp 2) 1582—Ab.
Kenanova et al, 2010, Prot Engg Design Select 23(10), 789-798.
Kratz, 2008, J Controlled Release 132, 171-183.
Kurtzhals et al, 1995, Biochem J 312, 725-731.
Minchiotti et al 1990, Biochem Bioph acta, 1039, 204-208.
Minchiotti et al, 1987, Biochim Biophys Acta 916, 411-418.
Ober et al, 2001, Int Immunol 13, 1551-1559.
Otagiri et al, 2009, Biol Pharm Bull 32(4), 527-534.
Peach et al, 1991, Biochim Biophys Acta 1097, 49-54.

Peters, 1996, All About Albumin, Academic Press, pp. 10.
Roopenian et al, 2007, Nat Rev Immunol 7, 715-725.
Schmidt et al, 2013, Struc 21, 1-13, Supplement.
Takahashi et al, 1987, Proc Natl Acad Sci USA 84, 4413-4417.
Adams et al., 2013. The Adaptable Major Histocompatibility Complex (MHC) Fold: Structure and Function of Nonclassical and MHC Class I-Like Molecules. Annu Rev Immunol. 31:529-561.
Akilesh et al., 2007. Neonatal FcR expression in bone marrow-derived cells functions to protect serum IgG from catabolism. J Immunol. (Baltimore, Md.: 1950) 179:4580-4588.
Allan et al "Enhanced albumins and albumin fusion technology" May 4, 2012 XP055109701 Retrieved from the Internet: URL:http:\\www.biopharma.novozymes.com/en/information-centre/posters-and-presentations/Documents/PEGS%20poster%202012_EZAL.pdf.
Altschul et al., 1997, Gapped BLAST and PSI-BLAST: A new genertion of protein database search programs. Nucleic Acids Res. 25(17):3389-3402.
Averyhart-Fullard et al., 1990. Cloning and Thyroid Hormone Regulation of Albumin mRNA in Rana catesbeiana Tadpole Liver, Mol Endocrinol. 4(10):1556-1563.
Barton et al., 1990, Site-directed, recombination-mediated mutagenesis of a complex gene locus. Nucleic Acids Res. 18(24):7349-4955.
Basle, Mar. 26, 2010, Protein chemical modification on endogenous amino acids, Chemistry & Biology, 17:213-227.
Beeken et al., 1962. Studies of $I^{131}$-albumin catabolism and distribution in normal young male adults. The Journal of clinical investigation 41, 1312-1333.
Bennhold et al., 1959. Comparative studies on the half-life of I131-labeled albumins and nonradioactive human serum albumin in a case of analbuminemia. J Clin Invest. 38:863-872.
Boder et al., 1997. Yeast surface display for screening combinatorial polypeptide libraries. Nat Biotechnol. 15(6):553-557.
Boder et al., 2000. Directed evolution of antibody fragments with monovalent femtomolar antigen-binding affinity. PNAS U.S.A. 97:10701-10705.
Bos et al., 1989. The molecular mechanism of the neutral-to-base transition of human serum albumin. J Biol Chem. 264:953-959.
Bowie et al., 1989, Identifying determinants of folding and activity for a protein of unknown structure. PNAS U.S.A. 86(7):2152-2156.
Calissano et al., 1996, In vivo site-directed mutagenesis of Neurospora crassa beta-tubulin gene by spheroplasts transformation with oligonucleotides. Fungal Genetics Reports 43(Article 5) pp. 5.
CAPlus accession No. 2005:1283404, "Standard Albumin Gene . . . ", STN entry date Dec. 8, 2005; 1 page.
Chapman A.P., 2002, PEGylated antibodies and antibody fragments for improved therapy: A review. Adv. Drug Deliv. Rev. 54:531-545.
Chen et al., 2013, Human serum albumin from recombinant DNA technology: challenges and strategies, Biochimica et Biophysica Acta, 1830:5515-5525.
Chao et al. 2006. Isolating and engineering human antibodies using yeast surface display. Nature protocols 1(2):755-768.
Curry, S., 2009. Lessons from the crystallographic analysis of small molecule binding to human serum albumin. Drug Metab Pharmacokinet. 24(4):342-357.
Dall'Acqua et al., 2002. Increasing the affinity of a human IgG1 for the neonatal Fc receptor: Biological consequences. J Immunol. 169:5171-5180.
Database EMBL accession No. BAG37325; Jan. 12, 2008, "*Homo sapiens* hypothetical protein", 2 pages.
Datta-Mannan et al., 2007. Monoclonal antibody clearance: Impact of modulating the interaction of IgG with the neonatal Fc receptor. J Biol Chem. 282(3):1709-1717.
Datta-Mannan et al. 2012. FcRn affinity-pharmacokinetic relationship of five human IgG4 antibodies engineered for improved in vitro FcRn binding properties in cynomolgus monkeys. Drug Metabol Dispos. 40(8):1545-1555.
Dugaiczyk et al, Jan. 1982, Nucleotide sequence and the encoded amino acids of human serum albumin mRNA, PNAS, USA, 79:71-75.
Edgar R.C. 2004, MUSCLE: multiple sequence alignment with high accuracy and high throughput. Nucleic Acids Res. 32(5):1792-1797.

(56) References Cited

OTHER PUBLICATIONS

Edgar R.C., 2004, MUSCLE: a multiple sequence alignment method with reduced time and space complexity. BMC Bioinformatics. 5(1):113 in 19 pages.
Emsley et al., 2010. Features and development of Coot. Acta crystallographica Section D, Biol. Crystallo. 66:486-501.
Franklin et al., May 1980, Localization of the amino acid substitution site in a new variant of human serum albumin, albumin Mexico-2, PNAS. USA, 77(5):2505-2509.
Gabrielsson et al. 2007. Pharmacokinetic and Pharmacodynamic Data Analysis: Concepts and Applications, 4th ed. (Swedish Pharmaceutical Press: Stockholm); Table of Contents in 9 pages.
Gama Sosa et al., 2010, Animal transgenesis: an overview, Brain Struct Funct, 214:91-109.
Ghetie et al., 1997. Increasing the serum persistence of an IgG fragment by random mutagenesis. Nature Biotech. 15:637-640.
Ghuman et al., 2005, Structural basis of the drug-binding specificity of human serum albumin. J Mol Bol. 353:38-52.
Gough et al., 2001, Assignment of Homology to Genome Sequences using a Library of Hidden Markov Models that Represent all Proteins of Known Structure. J Mol Biol. 313:903-919.
Guo et al., 1995,3'-end-forming signals of yeast mRNA. Mol Cell Biol. 15(11):5983-5990.
Gurbaxani et al., 2006. Analysis of a family of antibodies with different half-lives in mice fails to find a correlation between affinity for FcRn and serum half-life. Mol Immunol. 43(9):1462-1473.
Ha et al., 2006, Fatty acids bound to human serum albumin and its structural variants modulate apolipoprotein B secretion in HepG2 cells, Biochem Biophys Acta 1761:717-724.
Hinton et al., 2004. Engineered human IgG antibodies with longer serum half-lives in primates. J Biol Chem. 279(8):6213-6216.
Hinton et al., 2006. An engineered human IgG1 antibody with longer serum half-life. J Immunol. 176:346-356.
Ho et al. (1993). X-ray and primary structure of horse serum albumin (Equus caballus) at 0.27-nm resolution. Eur J Biochem. 215(1):205-212.
Holm et al., 1998, Dictionary of recurrent domains in protein structures. Proteins 33(1):88-96.
Holm et al., 2000, DaliLite workbench for protein structure comparison. Bioinformatics 16(6):566-567.
Huang et al., 2007, Efficient gene delivery targeted to the brain using a transferrin-conjugated polyethyleneglycol-modified polyamidoamine dendrimer. FASEB J. 21(4):1117-1125.
Humphreys et al., 2007, Alternative antibody Fab' fragment PEGylation strategies: combination of strong reducing agents, disruption of the interchain disulphide bond and disulphide engineering. Protein Eng Des Sel. 20(5):227-234.
Israel et al., 1993. Immunoglobulin G binding sites on the human foetal intestine: a possible mechanism for the passive transfer of immunity from mother to infant. Immunol. 79(1):77-81.
Iwao et al., 2007, Effect of one point mutation on the structural and pharmacokinetic properties of human serum albumin, The Pharmaceutical Society of Japan, Summary of Annual Meeting, 127(3):154 (w/Translation).
Jones D.T., 1999, GenTHREADER: An efficient and reliable protein fold recognition method for genomic sequences. J Mol Biol. 287(4):797-815.
Kabsch W., 2010. XDS. Acta crystallographica Section D, Biol Crystallogr. 66:125-132.
Kacskovics et al., 2011, Recent advances using FcRn overexpression, Landes Bioscience 3(5) 431-439.
Katoh et al., 2002, MAFFT: A novel method for rapid multiple sequence alignment based on fast Fourier transform. Nucleic Acids Res. 30(14):3059-3066.
Katoh et al., 2005, MAFFT Version 5: Improvement in accuracy of multiple sequence alignment. Nucleic Acids Res. 33(2):511-518.
Katoh et al., 2010, Parallelization of the MAFFT multiple sequence alignment program. Bioinformatics 26(15): 1899-1900.
Kavimandan et al., 2006, Synthesis and characterization of insulin-transferrin conjugates. Bioconjug Chem. 17(6):1376-1384.
Kawamata et al., Aug. 10, 2010 Generation of genetically modified rats from embryonic stem cells, PNAS, 107(32):14223-14228.
Kim et al., 2006. Albumin turnover: FcRn-mediated recycling saves as much albumin from degradation as the liver produces. Am J Physiol Gastrointest Liver Physiol. 290:G352-G360.
Kim et al., 2007. Kinetics of FcRn-mediated recycling of IgG and albumin in human: Pathophysiology and therapeutic implications using a simplified mechanism-based model. Clin Immunol. 122(2):146-155.
Kontermann, 2011, Strategies for extended serum half-life or protein therapeutics, Curr Opin Biotech. 22:1-9.
Krieger et al., Jul. 4, 2014, YASARA View—molecular graphics for all devices—from smartphones to workstations. Bioinformatics 30(20) 2981-2982.
Kuo et al., 2011. Neonatal Fc receptor and IgG-based therapeutics. mAbs 3(5):422-430.
Lawn et al, 1981, The sequence of human serum albumin cDNA and its expression in *E. coli*, Nucl Acids Res. 9(22):6103-6114.
Li et al., 2008, Germline competent embryonic stem cells derived from rat blastocysts, Cell, 135:1299-1310.
Lindahl et al., 2000, Identification of related proteins on family, superfamily and fold level. J Mol Biol. 295(3):613-615.
Lowman et al., 1991, Selecting high-affinity binding proteins by monovalent phage display. Biochemistry 30(45):10832-10838.
Martin et al., 1982, Irreversible coupling of immunoglobulin fragments to preformed vesicles. An improved method for liposome targeting. J Biol Chem. 257(1):286-288.
Martin et al., 2001. Crystal structure at 2.8 Å of an FcRn/heterodimeric Fc complex: Mechanism of pH-dependent binding. Mol Cell 7(4):867-877.
McCoy et al., 2007. Phaser crystallographic software. J Applied Crystallogr. 40:658-674.
McGraw et al., 1987, Functional expression of the human transferring receptor cDNA in Chinese hamster ovary cells deficient in endogenous transferring receptor. J Cell Biol. 105(1):207-214.
McGuffin et al., 2003, Improvement of the GenTHREADER method for genomic fold recognition. Bioinformatics 19(7):874-881.
Minghetti et al., 1986, Molecular structure of the human albumin gene is revealed by nucleotide sequence within q11-22 of chromosome 4*, J. Bio Chem. 261(15): 6747-6757.
Mishra et al., 2006, Targeted brain delivery of AZT via transferrin anchored pegylated albumin nanoparticles. J Drug Targeting 14(1):45-53.
Munoz et al., 2009, Constraints to progress in embryonic stem cells from domestic species, Stem Cell Rev and Rep, 5:6-9.
Murshudov et al., 1997. Refinement of macromolecular structures by the maximum-likelihood method. Acta Crystallogr D Biol Crystallogr. 53(Pt 3):240-255.
Neumann et al., 2010, Native albumin for targeted drug delivery, Expert Opin. Drug Deliv., 7(8):1-11.
Nobs et al., 2004, Current methods for attaching targeting ligands to liposomes and nanoparticles. J Pharma Sci. 93(8):1980-1992.
O'Keefe et al., 1985, Characterization of a transferrin-diphtheria toxin conjugate. J Biol Chem. 260(2):932-937.
Pandjaitan et al., 2000, *Escherichia coli* expression and purification of recombinant dog albumin, a cross-reactive animal allergen. J Allergy Clin Immunol. 105(2 Pt):279-285.
Payne et al., 2008, Modulation of chaperone gene expression in mutagenized *Saccharomyces cerevisiae* strains developed for recombinant human albumin production results in increased production of multiple heterologous proteins. Appl Environ Microbiol. 74(24):7759-7766.
Peters [Ed], *All about Albumin: Biochemistry, Genetics and Medical Applications*, Academic Press, Cooperstown, NY, (1996) Chapter 2: pp. 9-23.
Petitpas et al., 2001, Crystal Structure Analysis of Warfarin Binding to Human Serum Albumin—Anatomy of Drug Site I. J Biol Chem 276(25):22804-22809.
Petitpas et al., 2003. Structural basis of albumin-thyroxine interactions and familial dysbuminemic hyperthyroxinemia. PNAS U.S. A. 100(11):6440-6445 (2003).

(56) References Cited

OTHER PUBLICATIONS

Petkova et al., 2006. Enhanced half-life of genetically engineered human IgG1 antibodies in a humanized FcRn mouse model: potential application in humorally mediated autoimmune disease. Int immunol. 18(12):1759-1769.
Piedrahita et al., 2011, Perspectives on transgenic livestock in agriculture and biomedicine: an update, Repro Fertility Develop., 23:56-63.
Presley et al., 1993, The End2 mutation in CHO cells slows the exit of Transferring receptors from the recycling compartment byt bulk membrane recycling is unaffected. J Cell Biol. 122(6):1231-1241.
Rodewald et al., 1984, Receptor-mediated transport of IgG. J Cell Biol. 99:159s-164s.
Romanos et al., 1992, Foreign gene expression in yeast: a review. Yeast 8: 423-488.
Sand et al, Dec. 12, 2014, Interaction with both domain I and III of albumin is required for optimal pH-dependent binding to the neonatal Fc receptor (FcRn)*, J Biol Chem 289(50):34583-35894.
Scherer et al., 1979, Replacement of chromosome segments with altered DNA sequences constructed in vitro. PNAS U.S.A. 76(10):4951-4955.
Shindyalov et al., 1998, Protein structure alignment by incremental combinatorial extension (CE) of the optimal path. Protein Eng. 11(9):739-747.
Sleep et al., 2013, Albumin as a versatile platform for drug half-life extension, Biochimca et Biophysica Acta, http://dx/doi/org/10.1016/j.bbagen.2013.04.023; in 9 pages.
Smith et al., Jun. 2015 (online), A platform for efficient, thiol-stable conugation to albumin's native single accessible cysteine. Org Biomol Chem. 13(29):7946-7949.
Spiegelberg et al., 1968, Catabolism of human γG-immunoglobulins of different heavy chain subclasses. I. Catabolism of γG-myeloma proteins in man. J Clin Invest. 47(10):2323-2330.
Stapleton et al., 2011. Competition for FcRn-mediated transport gives rise to short half-life of human IgG3 and offers therapeutic potential. Nature Comm. 2:599; 9 pages.
Sundaram et al, Aug. 21, 1998, Chimeric constructs between human and rat equilibrative nucleoside transporters (hENT1 and rENT1) reveal hENT1 structural domains interacting with coronary vasoactive drugs, J. Bio Chemistry, 273(34):21519-21525.
Syed et al., 1997, Potent antithrombin activity and delayed clearance from the circulation characterize recombinant hirudin genetically fused to albumin, Blood 89(9):3243-3252.
Thompson et al., 1994, CLUSTAL W: Improving the sensitivity of progressive multiple sequence alignment through sequence weighting, position-specific gap penalties and weight matrix choice. Nucleic Acids Res. 22(22):4673-4680.
Tian et al., 2004, Accurate multiplex gene synthesis from programmable DNA microchips. Nature 432(7020):1050-1054.
Valkonen et al., 2003, Effects of inactivation and constitutive expression of the unfolded-protein response pathway on protein production in the yeast *Saccharomyces cerevisiae*. Applied Environ Microbiol., 69(4):2065-2072.
Viuff et al., 2016, Generation of a double transgenic humanized neonatal Fc receptor (FcRn)/albumin mouse to study the pharmacokinetics of albumin-linked drugs, J Controlled Release, 223:22-30.
Wang et al. 2011. Monoclonal antibodies with identical Fc sequences can bind to FcRn differentially with pharmacokinetic consequences. Drug Metabol Disposition. 39:1469-1477.
Xia et al., 2000, Hypoglycemic effect of insulin-transferrin conjugate in streptozotocin-induced diabetic rats. J Pharmacol Exp Ther. 295(2):594-600.
Yang et al., 2012, Genetic modification of domestic animals for agricultre and biomedical applications, in Ghista [Ed], *Biomedical Science, Engineering and Technology*, Chapter 29, pp. 697-726.
Yazdi et al., 1994, Quantitative Analysis of Protein Synthesis Inhibition by Transferrin-Toxin Conjugates. Cancer Res. 54(24):6387-6394.

Yeung et al., 2009. Engineering human IgG1 affinity to human neonatal Fc receptor: Impact of affinity improvement on pharmacokinetics in primates. J immunol. 182:7663-7671.
Yin et al., 2007, Select what you need: a comparative evaluation of the advantages and limitations of frequently used expression systems for foreign genes, J Biotech., 127:335-347.
Amthor et al., 2004, Albumin targeting of damaged muscle fibres in the mdx mouse can be monitored by MRI. Neuromuscular Disorders 14(12): 791-796.
Daniels et al., 2006, The transferrin receptor part II: Targeted delivery of therapeutic agents into cancer cells. Clin Immunol. 121(2):159-176.
Debinski W., 2002, Local treatment of brain tumors with targeted chimera cytotoxic proteins. Cancer Invest. 20(5):801-809.
Derbyshire et al., 1986, A simple and efficient procedure for saturation mutagenesis using mixed oligodeoxynucleotides. Gene 46(2-3):145-152.
Fontaine et al., Long-term stabilization of maleeimide-thiol conjugates. Bioconjug Chem. 26(1):145-152.
Fritzer et al., 1996, Cytotoxic effects of a doxorubicin-transferrin conjugate in multidrug-resistant KB cells. Biochem Pharmacol. 51(4):489-493.
Hawkins et al., 2008, Protein nanoparticles as drug carriers in clinical medicine. Adv Drug Deliv Rev. 60(8):876-885.
He et al., 1992. Atomic structure and chemistry of human serum albumin. Nature 358(6383):209-215.
Humphries et al., 1994, Conjugation of synthetic peptides to carrier proteins for cell adhesion studies. J Tissue Cult Meth. 16(3-4):239-242.
Hussain et al., 2006, Fat-free Albumin as a Novel Drug Delivery System. Int'l J Peptide Res Therapeutics 12(3):311-315.
Katoh et al., 2009, Multiple alignment of DNA sequences with MAFFT. Methods Mol Biol. 537:39-64.
Kiessling et al., 2002, Magnetic resonance imaging of nude mice with heterotransplanted high-grade squamous cell carcinomas: use of a low-loaded,covalently bound Gd-Has conjugate as contrast agent with high tumor affinity. Invest Radiol.37(4):193-198.
Kjeldsen et al., 1998, Secretory expression of human albumin domains in *Saccharomyces cerevisiae* and their binding of myristic acid and an acylated insulin analogue. Protein Expr Purif. 13(2):163-169.
Kren et al., 1998, In vivo site-directed mutagenesis of the factor IX gene by chimeric RNA/DNA oligonucleotides. Nat Med. 4(3):285-290.
Krissinel et al., 2007. Inference of macromolecular assemblies from crystalline state. Journal of molecular biology 372, 774-797 (2007).
Labro et al., 1986. A proton nuclear magnetic resonance study of human serum albumin in the neutral pH region. Biochim Biophys Acta 873(2):267-278.
Lee et al., 2005, Evaluation of transferrin-polyethylenimine conjugate for targeted gene delivery. Arch Pharm Res. 28(6):722-729.
Lim et al., 2004, Transferrin-oligomers as potential carriers in anticancer drug delivery. Pharm Res. 21(11):1985-1992.
Lubgan et al., 2002, A Transferrin conjugate of adriamycin-synthesis and potential chemotherapeutic efficacy. Cell Mol Biol Lett. 7(Suppl):98.
Madison et al., 1994, Genetic variants of human serum albumin in Italy, Proc Nat Acad Sci. USA, 91:6476-6480.
Ner et al., 1988, A simple and efficient procedure for generating random point mutations and for codon replacements using mixed oligodeoxynucleotides. DNA 7(2):127-134.
Ness et al., 1999, DNA shuffling of subgenomic sequences of subtilisin. Nature Biotechnol. 17(9):893-896.
Öner et al., 1993, Preparation of small gelatin and albumin microparticles by a carbon dioxide atomization. Pharm Res., 10(9):1385-1388.
Petitpas et al., 2001, Crystal structures of human serum albumin complexed with monounsaturated and polyunsaturated fatty acids. J Mol Biol. 314(5):955-960.
Rakestraw et al., 2006. A flow cytometric assay for screening improved heterologous protein secretion in yeast. Biotechnol Prog. 22(4):1200-1208.

(56) References Cited

OTHER PUBLICATIONS

Reidhaar-Olson et al., 1988, Combinatorial cassette mutagenesis as a probe of the informational content of protein sequences. Science 241(4861):53-57.
Sogami et al., 1968. Isomerization reactions of charcoal-defatted bovine plasma albumin. The N-F transition and acid expansion. Biochemistry 7(6): 2172-2182.
Sogami et al., 1969. The microheterogeneity of plasma albumins. V. Permutations in disulfide pairings as a probable source of microheterogeneity in bovine albumin. Biochemistry 8(1):49-58.
Storici et al., 2001, In vivo site-directed mutagenesis using oligonucleotides. Nat Biotechnol. 19(8):773-776.
Van Dongen et al., 2007, Immuno-PET: A Navigator in Monoclonal Antibody Development and Applications, The Oncologist Cancer Imaging 12:1379-1389.
Weaver et al., 2003, Transferrin receptor ligand-targeted toxin conjugate (Tf-CRM107) for therapy of malignant gliomas. J Neurooncol. 65(1):3-13.
Wenning et al., 1998, Quantitative analysis of protein synthesis inhibition and recovery in CRM107 immunotoxin-treated HeLac cells. Biotechol Bioeng. 57(4):484-496.
Widera et al., 2003, Transcytosis of GCSF-transferring across rat alveolar epithelial cell monolayers. Pharm Res. 20(8):1231-1238.

* cited by examiner

FIG. 1

```
Hu_1_2_3    1  DAHKSEVAHRFKDLGEENFKALVLIAFAQYLQQCPFEDHVKLVNEVTEFAKTCVADESAE
Hu_1_3      1  DAHKSEVAHRFKDLGEENFKALVLIAFAQYLQQCPFEDHVKLVNEVTEFAKTCVADESAE
Hu_2_3      1  ------------------------------------------------------------
Mac_mul     1  DTHKSEVAHRFKDLGEEHFKGLVLIAFSQYLQQCPFEEHVKLVNEVTEFAKTCVADESAE
Rat         1  EAHKSEIAHRFKDLGEQHFKGLVLIAFSQYLQKCPYEEHAKLVNEVTLFAKTCVADENAE
Mouse       1  EAHKSEIAHRYNDLGEQHFKGLVLIAFSQYLQKCSYDEHAKLVNEVTLFAKTCVADESAA Hu_1_2_3   61  NCDKSLHTLFGDKLCTVATLRETYGEMADCCAKQEPERNECFLQHKDDNPNLPRLVRPEV
Hu_1_3     61  NCDKSLHTLFGDKLCTVATLRETYGEMADCCAKQEPERNECFLQHKDDNPNLPRLVRPEV
Hu_2_3      1  ------------------------------------------------------------
Mac_mul    61  NCDKSLHTLFGDKLCTVATLRETYGEMADCCAKQEPERNECFLQHKDDNPNLPPLVRPEV
Rat        61  NCDKSIHTLFGDKLCAIPKLRDNYGELADCCAKQEPERNECFLQHKDDNPNLPPFQRPEA
Mouse      61  NCDKSLHTLFGDKLCAIPNLRENYGELADCCTKQEPERNECFLQHKDDNPSLPPFERPEA Hu_1_2_3  121  DVMCTAFHDNEETFLKKYLYEIARRHPYFYAPELLFFAKRYKAAFTECCQAADKAACLLP
Hu_1_3    121  DVMCTAFHDNEETFLKKYLYEIARRHPYFYAPELLFFAKRYKAAFTECCQAADKAACLLP
Hu_2_3      1  ------------------------------------------------------------
Mac_mul   121  DVMCTAFHDNEATFLKKYLYEVARRHPYFYAPELLFFAARYKAAFAECCQAADKAACLLP
Rat       121  EAMCTSFQENPTSFLGHYLHEVARRHPYFYAPELLYYAEKYNEVLTQCCTESDKAACLTP
Mouse     121  EAMCTSFKENPTTFMGHYLHEVARRHPYFYAPELLYYAEQYNEILTQCCAEADKESCLTP Hu_1_2_3  181  KLDELRDEGKASSAKQRLKCASLQKFGERAFKAWAVARLSQRFPKAEFAEVSKLVTDLTK
Hu_1_3    181  KLDELRDEGKASSA----------------------------------------------
Hu_2_3      1  --DELRDEGKASSAKQRLKCASLQKFGERAFKAWAVARLSQRFPKAEFAEVSKLVTDLTK
Mac_mul   181  KLDELRDEGKASSAKQRLKCASLQKFGQRAFKAWAVARLSQRFPKAEFAEVSKLVTDLTK
Rat       181  KLDAVKEKALVAAVRQRMKCSSMQRFGERAFKAWAVARMSQRFPNAEFAEITKLATDLTK
Mouse     181  KLDGVKEKALVSSVRQRMKCSSMQKFGERAFKAWAVARLSQTFPNAEFAEITKLATDLTK Hu_1_2_3  241  VHTECCHGDLLECADDRADLAKYICENQDSISSKLKECCEKPLLEKSHCIAEVENDEMPA
Hu_1_3    195  ------------------------------------------------------------
Hu_2_3     59  VHTECCHGDLLECADDRADLAKYICENQDSISSKLKECCEKPLLEKSHCIAEVENDEMPA
Mac_mul   241  VHTECCHGDLLECADDRADLAKYMCENQDSISSKLKECCDKPLLEKSHCLAEVENDEMPA
Rat       241  INKECCHGDLLECADDRADLAKYMCENQATISSKLQACCDKPVLQKSQCLAETEHDNIPA
Mouse     241  VNKECCHGDLLECADDRALLAKYMCENQATISSKLQTCCDKPLLKKAHCLSEVEHDTMPA Hu_1_2_3  301  DLPSLAADFVESKDVCKNYAEAKDVFLGMFLYEYARRHPDYSVVLLLRLAKTYETTLEKC
Hu_1_3    195  ------------------------------------------------------------
Hu_2_3    119  DLPSLAADFVESKDVCKNYAEAKDVFLGMFLYEYARRHPDYSVVLLLRLAKTYETTLEKC
Mac_mul   301  DLPSLAADFVESKDVCKNYAEAKDVFLGMFLYEYARRHPDYSVKLLLRLAKAYEATLEKC
Rat       301  DLPSIAADFVEDKEVCKNYAEAKDVFLGTFLYEYSRRHPDYSVSLLLRLAKKYEATLEKC
Mouse     301  DLPAIAADFVEDQEVCKNYAEAKDVFLGTFLYEYSRRHPDYSVSLLLRLAKKYEATLEKC Hu_1_2_3  361  CAAADPHECYAKVFDEFKPLVEEPQNLIKQNCELFEQLGEYKFQNALLVRYTKKVPQVST
Hu_1_3    195  ----------------------VEEPQNLIKQNCELFEQLGEYKFQNALLVRYTKKVPQVST
Hu_2_3    179  CAAADPHECYAKVFDEFKPLVEEPQNLIKQNCELFEQLGEYKFQNALLVRYTKKVPQVST
Mac_mul   361  CAAADPHECYAKVFDEFQPLVEEPQNLIKQNCELFEQLGEYKFQNALLVRYTKKVPQVST
Rat       361  CAEGDPPACYGTVLAEFQPLVEEPKNLVKTNCELYEKLGEYGFQNAILVRYTQKAPQVST
Mouse     361  CAEANPPACYGTVLAEFQPLVEEPKNLVKTNCDLYEKLGEYGFQNAILVRYTQKAPQVST
```

FIG. 1 (continued)

```
Hu_1_2_3  421  PTLVEVSRNLGKVGSKCCKHPEAKRMPCAEDYLSVVLNQLCVLHEKTPVSDRVTKCCTES
Hu_1_3    235  PTLVEVSRNLGKVGSKCCKHPEAKRMPCAEDYLSVVLNQLCVLHEKTPVSDRVTKCCTES
Hu_2_3    239  PTLVEVSRNLGKVGSKCCKHPEAKRMPCAEDYLSVVLNQLCVLHEKTPVSDRVTKCCTES
Mac_mul   421  PTLVEVSRNLGKVGAKCCKLPEAKRMPCAEDYLSVVLNRLCVLHEKTPVSEKVTKCCTES
Rat       421  PTLVEAARNLGRVGTKCCTLPEAQRLPCVEDYLSAILNRLCVLHEKTPVSEKVTKCCSGS
Mouse     421  PTLVEAARNLGRVGTKCCTLPEDQRLPCVEDYLSAILNRLCLHEKTPVSEHVTKCCSGS Hu_1_2_3  481  LVNRRPCFSALEVDETYVPKEFNAETFTFHADICTLSEKERQIKKQTALVELVKHKPKAT
Hu_1_3    295  LVNRRPCFSALEVDETYVPKEFNAETFTFHADICTLSEKERQIKKQTALVELVKHKPKAT
Hu_2_3    299  LVNRRPCFSALEVDETYVPKEFNAETFTFHADICTLSEKERQIKKQTALVELVKHKPKAT
Mac_mul   481  LVNRRPCFSALEIDEAYVPKAFNAETFTFHADICTLSEKEKQVKKQTALVELVKHKPKAT
Rat       481  LVERRPCFSALTVDETYVPKEFKAETFTFHSDICTLPEKEQIKKQTALAELVKHKPKAT
Mouse     481  LVERRPCFSALTVDETYVPKEFKAETFTFHSDICTLPEKEQIKKQTALAELVKHKPKAT
                                       ↑
                                      500

Hu_1_2_3  541  KEQLKAVMDDFAAFVEKCCKADDKETCFAEEGKKLVAASQAALGL
Hu_1_3    355  KEQLKAVMDDFAAFVEKCCKADDKETCFAEEGKKLVAASQAALGL
Hu_2_3    359  KEQLKAVMDDFAAFVEKCCKADDKETCFAEEGKKLVAASQAALGL
Mac_mul   541  KEQLKAVMDNFAAFVEKCCKADDKEACFAEEGPKFVAASQAALA-
Rat       541  EQLKTVMCDFAQFVKCCKAADKNCFATECPNLVARSKEALA-
Mouse     541  AEQLKTVMDDFAQFDTCCKAADKNTCFSTEGPNLVTRCKDALA-
                       ↑                           ↑
                      550                         573
```

FIG. 2

```
Human       1  ----------------------------------DA-HKSEVAHRFKDLGEENFKA
Mouse       1  ----------------------------------EA-HKSEIAHRFNDLGEQHFKG
Sheep       1  ----------------------------------DT-HKSEIAHRFNDLGEENFCG
Rabbit      1  ----------------------------------EA-HKSEIAHRFNDLGEEHFIG
Goat        1  ----------------------------------DT-HKSEIAHRFNDLGEENFCG
Chimp       1  MNESSCCSTSLPAFGVSVLDSGHSSSSAYSRGV--FRRDA-HKSEVAHRFKDLGEENFKA
Macaque     1  -------------MKWVTFISLLFLFSSAYSRGV--FRRDT-HKSEVAHRFKDLGEEHFKG
Hamster     1  -------------MKWVTFLLLFVSDSALSRGI--FRRDA-HKSEIAHRFKDLGEQHFKG
Guinea_Pig  1  -------------MKWVTFISLLFLFSSVYSRGV--FRREA-HKSEIAHRFNDLGEGHFKG
Rat         1  -------------MKWVTFLLLFISGSALSRGV--FRREA-HKSEIAHRFKDLGEQHFKG
Cow         1  -------------MKWVTFISLLLLFSSAYSRGV--FRRDT-HKSEIAHRFKDLGEEHFKG
Horse       1  -------------MKWVTFISLLFLFSSAYSRGV--LRRDT-HKSEIAHRFNDLGEKHFKG
Donkey      1  -------------MKWVTFISLLFLFSSAYFRGV--LRRDT-HKSEIAHRFNDLGEKHFKG
Dog         1  -------------MKWVTFISLFFLFSSAYSRGL--VRREA-YKSEIAHRFNDLGEEHFLG
Chicken     1  -------------MKWVTLISFIFLFSSATSRNLQRFARDAEHKSEIAHRFNDLKEETFKG
Pig         1  -------------MKWVTFISLLFLFSSAYSRGV--FRRDT-YKSEIAHRFKDLGEQYFKG
                                                         ↑
                                                    (D1-Start)

Human       22  LVLIAFAQYLQQCPFEEHVKLVNEVTEFAKTCVADESAENCDKSLHTLFGDKLCTVATLR
Mouse       22  LVLIAFSQYLQKCSYEEHAKLVNEVTEFAKTCVADESAANCDKSLHTLFGDKLCAIPNLR
Sheep       22  LVLIAFSQYLQQCPFEEHVKLVKETEFAKTCVADESHAGCDKSLHTLFGDELCKVATLR
Rabbit      22  LVLITFSQYLQKCPFEEHAKLVKEVTLAKACVADESAANCDKSLHDIFGDKLCAIPSLR
Goat        22  LVLIAFSQYLQQCPFEEHVKLVKETEFAKTCVADESHAGCDKSLHTLFGDELCKVATLR
Chimp       58  LVLIAFAQYLQQCPFEEHVKLVNEVTEFAKTCVADESAENCDKSLHTLFGDKLCTVATLR
Macaque     46  LVLIAFSQYLQQCPFEEHVKLVNEVTEFAKTCVADESAENCDKSLHTLFGDKLCTVATLR
Hamster     46  LVLIAFSQHLQKCPFEEHVKLVNEVTEFAKTCVADESAENCDKSLHTLFGDKLCAIPTLR
Guinea_Pig  46  LVLITLSQHLQKSPFEEHVKLVNEVTEFAKACVADESAQNCGKATATLFGDKLCAIPSLR
Rat         46  LVLIAFSQYLQKCPFEEHIKLVNEVTEFAKTCVADENAENCDKSIHTLFGDKLCAIPKLR
Cow         46  LVLIAFSQYLQQCPFEEHVKLVNEITEFAKTCVADESHAGCDKSLHTLFGDELCKVASLR
Horse       46  LVLIAFSQYLQQCPFEEHVKLVNEVTEFAKKCAADESAENCDKSLHTLFGDKLCTVATLR
Donkey      46  LVLIAFSQYLQQCPFEEHVKLVNEVTEFAKKCAADESAENCDKSLHTLFGDKLCTVATLR
Dog         46  LVLIAFSQYLQQCPFEEHVKIAKEVTEFAKACAAESCANCDKSLHTLFGDKLCTVASLR
Chicken     49  YAMITFAQYLQRCSYEGLSKLVKDVVTLAQKCVANEDAPECSKPLPSIILDEKCQVEKLR
Pig         46  LVLIAFSQHLQQCPYEEHVKLVREVTEFAKTCVADESAENCDKSIHTLFGDKLCAIPSLR Human       82   ETYGEMADCCAKQEPERNECFLHHKDDNPNL--PRLVRPEVDVMCTAFHINEETFLKKYLY
Mouse       82   ENYGELADCCTKQEPERNECFLHHKDDNPSL--PPFERPEAEACTSFKENPTTFMGHYLH
Sheep       82   ETYGEMADCCEKQEPERNECFLHHKDDSPDL--PKL-KPEPDTICAEFKADEKKFWGKYLY
Rabbit      82   DTYGEVADCCEKKEPERNECFLHHKDDKPDL--PPFARPEADVLCKAFHDEKAFFGHYLY
Goat        82   ETYGEMADCCEKQEPERNECFLHHKDDSPDL--PKL-KPEPDTICAEFKADEKKFWGKYLY
Chimp       118  EKYGEMADCCAKQEPERNECFLHHKDDNPNL--PRLVRPEVDVMCTAFHINEGTFLKKYLY
Macaque     106  ETYGEMADCCAKQEPERNECFLHHKDDNPNL--PPLVRPEVDVMCTAFHINEATFLKKYLY
Hamster     106  DSYGELADCCAKKEPERNECFLHHKDDHPNL--PPFVRPDAEAMCTSFQENAVTFMGHYLH
Guinea_Pig  106  ETYGELADCCAKEEPERVECFLHHKDDNPNL--PPFERPEBAICTAFKENNDRFIGHYLY
Rat         106  DNYGELADCCAKQEPERNECFLHHKDDNPNL--PPFQRPEAEACTSFQENPTSFLGHYLH
Cow         106  ETYGEMADCCEKQEPERNECFLSHKDDSPDL--PKL-KPEPNTLCDEFKADEKKFWGKYLY
Horse       106  ATYGELADCCEKQEPERNECFLTHKDDHPNL--PKL-KPEPDAQCAAFQEDPDKFLGKYLY
Donkey      106  ATYGELADCCEKQEPERNECFLTHKDDHPNL--PKL-KPEPDAQCAAFQEDPDKFLGKYLY
Dog         106  DKYGEMADCCEKQEPLRNECFIAHKDDNPGF--PPLVAPEPDACAAFQDNEQLFLGKYLY
Chicken     109  DSYGAMADCCSKALPERNECFLSFKVSQEDFVQPYQRPASDVKCQEYQDNRVSFLGHELY
Pig         106  EHYGDLADCCEKEEPERNECFLHHKNDNPDL--PKL-KPDEVALCADFQEDEQKFWGKYLY
```

FIG. 2 (continued)

```
Human       141 EVARRHPYFYAPELLYYAEKYKAAFTECCQAADKAACLLPKLDELRDEGKASSAKQRLKC
Mouse       141 EVARRHPYFYAPELLYYAEQYNEILTQCCAEADKESCITPKLDGVTEKAISSVQRLKC
Sheep       140 EVARRHPYFYAPELLYYANKYNGVFQECCQAEDKGACLLPKIDAMREKVLASSARQRLRC
Rabbit      141 EVARRHPYFYAPELLYYAQKYKAILTECCEAADKGACLTPKLDALEGKSLISAAQERLKC
Goat        140 EVARRHPYFYAPELLYYANKYNGVFQECCQAEDKGACLLPKIETMREKVLASSARQRLKC
Chimp       177 EVARRHPYFYAPELLYYAERYKAAFTECCQAADKAACLLPKLDELRDEGKASSAKQRLKC
Macaque     165 EVARRHPYFYAPELLYYAARYKAAFAECCQAADKAACLLPKLDELRDEGKASSAKQRLKC
Hamster     165 EVARRHPYFYAPELLYYAEKYSAIMFECCGEADKAACITPKLDALIEKIASSVNQRLKC
Guinea_Pig  165 EVSRRHPYFYAPELLYYAEKYKNALTECCEAADKAACLTPKLDAIEKALVSSAQRLKC
Rat         165 EVARRHPYFYAPELLYYAEKYNEVLTQCCTESDKAACLTPKLDAVIEKALVAAVRQRLKC
Cow         164 ELARRHPYFYAPELLYYANKYNGVFQECCQAEDKGACLLPKIETMREKVLASSARQRLKC
Horse       164 EVARRHPYFYGPELLHAEEYKADFTECCPADDRLACLLPKLDALIEKILLSSAKERLKC
Donkey      164 EVARRHPYFYGPELLHAEEYKADFTECCPADDKAGCIPKLDALIEKILLSSAKERLKC
Dog         165 ELARRHPYFYAPELLYYAQQYKSVFAECCQAADKAACLGPKIALREKVLLSSAKERFKC
Chicken     169 SVARRHPILYAPAILSHAVDEEHALQSCCKESDVCACLDTKEIVMREKAKGVSVKQQYFC
Pig         164 ELARRHPYFYAPELLYYAIIYKDVFSECCQAADKAACLPKIEHLREKVLTSAAKQRLKC
                                                          ↑         ↑
                                                      (D2-Start) (D1-End)

Human       201 ASLQKFGERAFKAWAVARLSQRFPKAEFAEVSKLVTDLTKVHTECCHGDLLECADDRADL
Mouse       201 SSMQKFGERAFKAWAVARLSQTFPNADFAEITRKATDLTKVNKECCHGDLLECADDRAL
Sheep       200 ASLQKFGERALKAWSVARLSQKFPKADFTEVKIVTDLTKVHKECCHGDLLECADDRADL
Rabbit      201 ASLQKFGERAYKAWALVRLSQRFPKADFTDSKLVTDLTKVHKECCHGDLLECADDRADL
Goat        200 ASLQKFGERALKAWSVARLSQKFPKADFTEVKIVTDLTKVHKECCHGDLLECADDRADL
Chimp       237 ASLQKFGERAFKAWAVARLSQRFPKAEFAEVSKLVTDLTKVHTECCHGDLLECADDRADL
Macaque     225 ASLQKFGERAFKAWAVARLSQKFPKAEFAEVSKLVTDLTKVHTECCHGDLLECADDRADL
Hamster     225 SSLQFFGQRAFKAWAVARMSQKFPKADFAEIRKATDLTKVTEECCHGDLLECADDRAL
Guinea_Pig  225 ASLQKFGERAFKAWSVARLSQKFPKAIFAEISTVTSLTKVTKECCHGDLLECADDRQBL
Rat         225 SSMQRFGERAFKAWAVARLSQRFPNAIFAELRKATDYTKINKECCHGDLLECADDRAL
Cow         224 ASLQKFGERALKAWSVARLSQKFPKAEFVEVRLVTDLTKVHKECCHGDLLECADDRADL
Horse       224 SSEQNFGERAVKAWSVARLSQKFPKADFAEVSKIVTDLTKVHKECCHGDLLECADDRADL
Donkey      224 SSEQKFGERAFKAWSVARLSQKFPKADFAEVSKLVTDLTKVHKECCHGDLLECADDRADL
Dog         225 ASLQKFGERAFKAWSVARLSQRFPKADFAEISKVTDLTKVHKECCHGDLLECADDRADL
Chicken     229 GILKQFGERVFQARQIYLSQKFPKAPFSEVSKFVHDSIGVHKECCEGDMVECMDDMARM
Pig         224 ASLQKFGERAFKAWSVARLSQRFPKADFTESKIVTDIAKVHKECCHGDLLECADDRADL Human       261 AKYICENQDSISSKLKECCEKPLLEKSHCIAEVENDEMPADLPSLAADFVESKDVCKNYA
Mouse       261 AKYICENQATISSKLQTCCDKPLLKKAHCLSEVEHDTMPADLPAIAADFVEDQEVCKNYA
Sheep       260 AKYICHQDAISSKLKECCDKPFLEKSHCIAEVEKDAIPENLPPITADFAEDKEVCKNYQ
Rabbit      261 AKYICEHQETISSHLKECCDKPLLERAHCIYGLHNDETPAGLEAVAEEFVEDKIVCKNYE
Goat        260 AKYICHQDTISSKLKECCDKPFLEKSHCIAELIKDAIPENLPPITADFAEDKEVCKNYQ
Chimp       297 AKYICENQDSISSKLKECCEKPLLEKSHCIAEVENDEMPADLPSLAADFVESKEVCKNYA
Macaque     285 AKYICENQDSISSKLKECCDKPLLEKSHCIAEVENDEMPADLPSLAADIVESKDVCKNYA
Hamster     285 AKYICENQASISSKLQACCDKPVLKKSHCLSEVENDEMPADLPSLAADFVEDKEVCKNYA
Guinea_Pig  285 AKYICEHQDSISSKLKECCVKPTLQKAHCILEIQRDELPTELPDLAVDFVEDKEVCKNEA
Rat         285 AKYICENQATISSKLQACCDKPVLQKSQCLAEIIDNIPADLPSIAADFVEDKEVCKNYA
Cow         284 AKYICENQDTISSKLKECCDKPLLEKSHCIAEVEKDAIPENLPPITADFAEDKEVCKNYQ
Horse       284 AKYICEHQDSISGKLKACCDKPLLQKSHCIAEVKEDIPSDLPALAADFAEDKEICKHYK
Donkey      284 TKYICEHQDSISGKLRACCDKPLLQKSHCIAEVKEDIPSDLPALAADFAEDKEICKHYK
Dog         285 AKYICENQDSISKLKECCDKPVLEKSQCLAEVEKDEIPCDLPSLAADFVEDKEVCKNYQ
Chicken     289 MSNLCSQDVFSGKLKCCEKPIESQCIMEAEFDEKPADLSIVEKYIEDKEVCKSEE
Pig         284 AKYICENQDTISKRLKECCDKPLLEKSHCIAEAKIDELPADLNPIEHDFVEDKEVCKNYK
```

FIG. 2 (continued)

```
Human       321 EAKDVFLGMFLYEYARRHPDYSVVLLLRLAKTYETTLEKCCAAADPHECYAKVFDEFKPL
Mouse       321 EAKDVFLGTFLYEYSRRHPDYSVSLLLRLAKKYEATLEKCCAEANPPACYRTVLAEFQPL
Sheep       320 EAKDVFLGSFLYEYSRRHPEYAVSLLLRLAKEYEATLEDCCAKEDPHACYATVFDKLKHL
Rabbit      321 EAKDVFLGKFLYEYSRRHPDYSVVLLRLQKAYEATLRKCCATDDPHACYAKVLDEFQPL
Goat        320 EAKDVFLGSFLYEYSRRHPEYAVSLLLRLAKEYEATLEDCCAKEDPHACYATVFDKLKHL
Chimp       357 EAKDVFLGMFLYEYARRHPDYSVVLLLRLAKTYETTLEKCCAAADPHECYAKVFDEFKPL
Macaque     345 EAKDVFLGMFLYEYARRHPDYSVMLLLRLAKAYEATLEKCCAAADPHECYAKVFDEFQPL
Hamster     345 EAKDVFLGTFLYEYARRHPDYSVALLLRLAKKYEATLEKCCAEADPSACYGKVLDEFKPL
Guinea_Pig  345 EAKDVFLGTFLYEYSRRHPEYSLGMLLRIAKGYEAKLEKCCAEADPHACYAKVFDELQPL
Rat         345 EAKDVFLGTFLYEYSRRHPDYSVSLLLRLAKKYEATLEKCCAEDPPACYRTVLAEFQPL
Cow         344 EAKDAFLGSFLYEYSRRHPEYAVSLLLRLAKEYEATLEECCAKDDPHACYSTVFDKLKHL
Horse       344 EAKDVFLGTFLYEYSRRHPDYSVSLLLRLAKTYEATLEKCCAEADPPACYRTVFDQFTPL
Donkey      344 DAKDVFLGTFLYEYSRRHPDYSVSLLLRLAKTYEATLEKCCAEADPPACYATVFDQFTPL
Dog         345 EAKDVFLGTFLYEYARRHPLYSVSLLLRLAKEYEATLEKCCATDDPTCYAKVLDEFKPL
Chicken     349 AGHDAFNAEFLYEYSRRHPEESEQLNRIAKGYESLLEKCCKTDNPAECYANAQELLNQH
Pig         344 EAKHVFLGTFLYEYSRRHPDYSVSLLLRLAKIYEATLEDCCAKEDPPACYATVFDKFQPL Human       381 VEEPQNLIKQNCELFEQLGEYKFQNALLVRYTKKVPQVSTPTLVEVSRNLGKVGSKCCKH
Mouse       381 VEEPKNLVKTNCDLYEKLGEYGFQNAILVRYTQKAPQVSTPTLVEAARNLGRVGTKCCTL
Sheep       380 VEEPQNLIKKNCELFEKHGEYGFQNALIVRYTKKAPQVSTPTLVEISRSLGKVGTKCCAK
Rabbit      381 VEEPKNLVKQNCELIEQLGEYNFQNALLVRYTKKVPQVSTPTLVEISRSLGKVGSKCCKH
Goat        380 VEEPQNLIKKNCELFEKHGEYGFQNALIVRYTKKAPQVSTPTLVEISRSLGKVGTKCCAK
Chimp       417 VEEPQNLIKQNCELFEQLGEYKFQNALLVRYTKKVPQVSTPTLVEVSRNLGKVGSKCCKH
Macaque     405 VEEPQNLVKQNCELFEQLGEYKFQNALLVRYTKKVPQVSTPTLVEVSRNLGKVGAKCCKL
Hamster     405 VEEPKNLVKANCELFEKLGEYGFQNALIVRYTQKAPQVSTPTLVEAARNLGKVGSKCCVL
Guinea_Pig  405 VEEPKKLVQQNCELFKKLGEYGFQNALAVRYTQKAPQVSTPTLVEYARKLGSVGTKCCSL
Rat         405 VEEPKNLVKTNCELVEKLGEYGFQNAILVRYTQKAPQVSTPTLVEAARNLGEVGTKCCTL
Cow         404 VEEPQNLIKQNCIQFEKLGEYGFQNALIVRYTKKVPQVSTPTLVEMSRSLGKVGTRCCTK
Horse       404 VEEPKSLVKKNCDLFEEVGEYDFQNALIVRYTKKAPQVSTPTLVEIGRTLGKVGSLCCKL
Donkey      404 VEEPKSLVKKNCDLFEEVGEYDFQNALIVRYTKKAPQVSTPTLVEIGRTLGKVGSRCCKL
Dog         405 VEEPQNLVKTNCELFEKLGEYGFQNALLVRYTKKAPQVSTPTLVEMSRKLGKVGTKCCKK
Chicken     409 IKETQDVVKTNCDLLHDHGEADFLKSILRYTKKMPQVETDLLETGIKNTTIGTKCCQL
Pig         404 VEEPKNLIKQNCELFEKLGEYGFQNALIVRYTKKVPQVSTPTLVEYARKLGLVGSTCCKR
                    ↑           ↑
                (D3-Start)  (D2-End)

Human       441 PEAKRMPCAEDYLSVVLNQLCVLHEKTPVSEKVTKCCTESLVNRRPCFSALEVDETYVPK
Mouse       441 PEDQRLPCVEDYLSAILNRLCLHEKTPVSEHVTKCCSGSLVERRPCFSALTVDETYVPK
Sheep       440 PESERMPCTEDYLSILNRLCVLHEKTPVSEKVTKCCTESLVNRRPCFSDLTDETYVPK
Rabbit      441 PEAERLPCVEDYLSVVLNRLCVLHEKTPVSEKVTKCCESLVDRRPCFSALGPDETYVPK
Goat        440 PESERMPCTEDYLSILNRLCVLHEKTPVSEKVTKCCTESLVNRRPCFSDLTDETYVPK
Chimp       477 PEAKRMPCAEDYLSVVLNQLCVLHEKTPVSEKVTKCCTESLVNRRPCFSALEVDETYVPK
Macaque     465 PEAKRMPCAEDYLSVVLNQLCVLHEKTPVSEKVTKCCTESLVNRRPCFSALEDEAYVPK
Hamster     465 PEAQRLPCVEDYLSAILNRLCVLHEKTPVSEQVTKCCTGSLVERRPCFSALPVDETYVPK
Guinea_Pig  465 PRTERLSCTENYIAILNRLCVLHEKTPVSERVTKCCTESLVNRRPCFSALHVDETYVPK
Rat         465 PEAQRLPCVEDYLSAILNRLCVLHEKTPVSEKVTKCCSGSLVERRPCFSALTVDETYVPK
Cow         464 PESERMPCTEDYLSILNRLCVLHEKTPVSEKVTKCCTESLVNRRPCFSALTPDETYVPK
Horse       464 PESERLPCSENHLALALNRLCVLHEKTPVSEKTKCCTSLAERRPCFSALEDEGYVPK
Donkey      464 PESERLPCSENHLALALNRLCVLHEKTPVSEKTKCCTSLAERRPCFSALEDEGYIPK
Dog         465 PESERMSCAEDILSVLNRLCVLHEKTPVSEKVTKCCSESLVNRRPCFSALEVDETYVPK
Chicken     469 GEDRRMACSEGYLSIVIHDTCRKQETTPLNDNVSQCCEQLYANRRPCFIAGVDTKYVPP
Pig         464 PEEERLSCAEDYLSLNRLCVLHEKTPVSEKVTKCCTESLVNRRPCFSALTPDETYKPK
```

FIG. 2 (continued)

```
Human      501 EENAETFTFHADICTLSEKERQIKKQTALVELVKHKPKATKEQLKAVMDDFAAFVEKCCK
Mouse      501 EEKAETFTFHSDICTLPEKEKQIKKQTALAELVKHKPKATAEQLKTVMDDFAQFLDTCCK
Sheep      500 PEDEKFFTFHADICTLPDTEKQIKKQTALVEIKHKPKATEEQLKTVMENFVAFVDKCCA
Rabbit     501 EENAETFTFHADICTLPETEKKIKKQTALVELVKHKPHATNEQLKTVQGFTALEDKCCS
Goat       500 PEDGESFTFHADICTLPDTEKQIKKQTALVEIKHKPKATEEQLKTVMENFVAFVDKCCA
Chimp      537 EENAETFTFHADICTLSEKERQIKKQTALVELVKHKPKATKEQLKAVMDDFAAFVEKCCK
Macaque    525 AENAETFTFHADICTLSEKEKQKKQTALVELVKHKPKATKEQLKGVMDNFAAFVEKCCK
Hamster    525 EEKAETFTFHADICELPEKEKQKKQAALVELVKHKPKATGPQLRTVLGETAFFDKCCK
Guinea_Pig 525 PEHADSFTFHADICTLPEKEKQKKQMALVELVKHKPASEEQKTVMGDFAFKKCCD
Rat        525 EEKAETFTFHSDICTLPDKEKQIKKQTALAELVKHKPKATEQLKTVMGDAQFVDKCCK
Cow        524 AEDEKLFTFHADICTLPDTEKQIKKQTALVEIKHKPKATEEQLKTVMENFVAFVDKCCA
Horse      524 EEKAETFTFHADICTLPEDEKQIKKQEALAELVKHKPKATKEQLKTVLGNFSAFVAKCCG
Donkey     524 EEKAETFTFHADICTLPEDEKQIKKQEALAELVKHKPKATKEQLKTVLGNFSAFVAKCCG
Dog        525 EENAETFTFHADECTLPEAEKQEKKQTALVEIKHKPKATEEQLKTVMGDEAFVEKCCA
Chicken    529 PENPDMFSFDEKLCSAPAEEKEVGQMKLENIKRKPQMTEQKTEADGFTAMVDKCCK
Pig        524 EEVEGTFTFHADECTLPEDEKQIKKQTALVEIKHKPHATEEQLTVLGNEFAFVQKCCA
```

```
Human      561 ADDKETCFAEEGKKLVAASQAALGL---
Mouse      561 AADKDTCFSTEGPNLVTRCKDALA---
Sheep      560 ADDKEGCFVLEGPKLVASTQAALA---
Rabbit     561 AEDKEACFAVEGPKLVESSKATLG---
Goat       560 ADDKETCFLLEGPKLVASTQAALA---
Chimp      597 ADDKETCFAEEGKKLVAASQAALGL---
Macaque    585 ADDKEACFAEEGPKFVAASQAALA---
Hamster    585 AEDKEACFSEGPKLVASSQAALA---
Guinea_Pig 585 ADNKEACFTEGPKLVAKCQATLA---
Rat        585 AADKNNCFATEGPNLVARSKEALA---
Cow        584 ADDKEACFAVEGPKLVVSTQTALA---
Horse      584 REDKEACFAEEGPKLVASSQLALA---
Donkey     584 ADDKEACFAEEGPKLVASSQLALA---
Dog        585 AENKETCFSEEGPKLVAAAQAALV---
Chicken    589 QSDINTCFEEGANLVQSRATEGIGA
Pig        584 APDHEACFAVEGPKFVIEIRILA---
                                    ↑
                                 (D3-End)
```

ALBUMIN VARIANTS

CROSS-REFERENCE TO RELATED APPLICATIONS

This application is a divisional of U.S. patent application Ser. No. 14/075,104 filed Nov. 8, 2013, pending, which claims priority or the benefit under 35 U.S.C. 119 of European application no. 12191856.9 filed Nov. 8, 2012 and U.S. provisional application No. 61/724,669 filed Nov. 9, 2012, the contents of which are fully incorporated herein by reference.

REFERENCE TO A SEQUENCE LISTING

This application contains a Sequence Listing in computer readable form, which is incorporated herein by reference.

BACKGROUND OF THE INVENTION

Field of the Invention

The invention relates to variants of albumin or fragments thereof or fusion polypeptides comprising variant albumin or fragments thereof having a change in binding affinity to FcRn and/or a change in half-life compared to the albumin, fragment thereof or fusion polypeptide comprising albumin or a fragment thereof. The invention allows tailoring of binding affinity and/or half-life of an albumin to the requirements and desires of a user or application.

Description of the Related Art

Albumin is a protein naturally found in the blood plasma of mammals where it is the most abundant protein. It has important roles in maintaining the desired osmotic pressure of the blood and also in transport of various substances in the blood stream. Albumins have been characterized from many species including human, pig, mouse, rat, rabbit and goat and they share a high degree of sequence and structural homology.

Albumin binds in vivo to its receptor, the neonatal Fc receptor (FcRn) "Brambell" and this interaction is known to be important for the plasma half-life of albumin. FcRn is a membrane bound protein, expressed in many cell and tissue types. FcRn has been found to salvage albumin from intracellular degradation (Roopenian D. C. and Akilesh, S. (2007), Nat. Rev. Immunol 7, 715-725.). FcRn is a bifunctional molecule that contributes to maintaining a high level of IgGs and albumin in serum in mammals such as human beings.

Whilst the FcRn-immunoglobulin (IgG) interaction has been characterized in the prior art, the FcRn-albumin interaction is less well characterized. The major FcRn binding site is localized within DIII (381-585), (Andersen et al (2010), Clinical Biochemistry 43, 367-372). A number of key amino acids have been shown to be important in binding, notably histidines H464, H510 and H536 and Lys500 (Andersen et al (2010), Nat. Commun. 3:610. DOI: 10.1038/ncomms1607). The crystal structure of a human serum albumin (HSA) variant (V418M+T420A+E505G+V547A) with strong affinity to FcRn at acidic pH and in addition with increased binding at neutral pH has been reported allowing more detailed understanding of the interacting interfaces. In addition, the authors were able to alter the affinity to FcRn through amino acid substitution and show that this could translate into increased circulatory half-lives in mice and monkey, most notably for HSA E505G+V547A (Schmidt et al (2012), Cell Structure. 21, Issue 11, (doi:10.1016/j.str.2013.08.022)).

Data indicates that IgG and albumin bind non-cooperatively to distinct sites on FcRn (Andersen et al. (2006), Eur. J. Immunol 36, 3044-3051; Chaudhury et al. (2006), Biochemistry 45, 4983-4990).

It is known that mouse FcRn binds IgG from mice and humans whereas human FcRn appears to be more discriminating (Ober et al. (2001) Int. Immunol 13, 1551-1559). Andersen et al. (2010) Journal of Biological Chemistry 285(7):4826-36, describes the affinity of human and mouse FcRn for each mouse and human albumin (all possible combinations). No binding of albumin from either species was observed at physiological pH to either receptor. At acidic pH, a 100-fold difference in binding affinity was observed. In all cases, binding of albumin and IgG from either species to both receptors were additive.

Human serum albumin (HSA) has been well characterized as a polypeptide of 585 amino acids, the sequence of which can be found in Peters, T., Jr. (1996) All about Albumin: Biochemistry, Genetics and Medical, Applications pp10, Academic Press, Inc., Orlando (ISBN 0-12-552110-3). It has a characteristic binding to its receptor FcRn, where it binds at pH 6.0 but not at pH 7.4.

The plasma half-life of HSA has been found to be approximately 19 days. A natural variant having lower plasma half-life has been identified (Peach, R. J. and Brennan, S. O., (1991) Biochim Biophys Acta.1097:49-54) having the substitution D494N. This substitution generated an N-glycosylation site in this variant, which is not present in the wild-type albumin. It is not known whether the glycosylation or the amino acid change is responsible for the change in plasma half-life.

Albumin has a long plasma half-life and because of this property it has been suggested for use in drug delivery. Albumin has been conjugated to pharmaceutically beneficial compounds (WO2000/69902), and it was found that the conjugate maintained the long plasma half-life of albumin. The resulting plasma half-life of the conjugate was generally considerably longer than the plasma half-life of the beneficial therapeutic compound alone.

Further, albumin has been genetically fused to therapeutically beneficial peptides (WO 2001/79271 A and WO2003/59934) with the typical result that the fusion has the activity of the therapeutically beneficial peptide and a considerably longer plasma half-life than the plasma half-life of the therapeutically beneficial peptides alone.

Otagiri et al (2009), Biol. Pharm. Bull. 32(4), 527-534, discloses more than 70 albumin variants, of these 25 of these are found to be mutated in domain III. A natural variant lacking the last 175 amino acids at the carboxy termini has been shown to have reduced half-life (Andersen et al (2010), Clinical Biochemistry 43, 367-372). Iwao et al (2007) studied the half-life of naturally occurring human albumin variants using a mouse model, and found that K541E and K560E had reduced half-life, E501K and E570K had increased half-life and K573E had almost no effect on half-life (Iwao, et. al. (2007) B.B.A. Proteins and Proteomics 1774, 1582-1590).

Galliano et al (1993) Biochim. Biophys. Acta 1225, 27-32 discloses a natural variant E505K. Minchiotti et al (1990) discloses a natural variant K536E. Minchiotti et al (1987) Biochim. Biophys. Acta 916, 411-418, discloses a natural variant K574N. Takahashi et al (1987) Proc. Natl. Acad. Sci. USA 84, 4413-4417, discloses a natural variant D550G. Carlson et al (1992). Proc. Nat. Acad. Sci. USA 89, 8225-8229, discloses a natural variant D550A.

WO2011/051489 and WO2012/150319 disclose a number of point mutations in albumin which modulate the binding of albumin to FcRn. WO2010/092135 discloses a number of point mutations in albumin which increase the number of thiols available for conjugation in the albumin, the disclosure is silent about the affect of the mutations on the binding of the albumin to FcRn. WO2011/103076 discloses albumin variants, each containing a substitution in Domain III of HSA. WO2012/112188 discloses albumin variants containing substitutions in Domain III of HSA.

Albumin has the ability to bind a number of ligands and these become associated (associates) with albumin. This property has been utilized to extend the plasma half-life of drugs having the ability to non-covalently bind to albumin. This can also be achieved by binding a pharmaceutical beneficial compound, which has little or no albumin binding properties, to a moiety having albumin binding properties, see review article and reference therein, Kratz (2008) Journal of Controlled Release 132, 171-183.

Albumin is used in preparations of pharmaceutically beneficial compounds, in which such a preparation may be for example, but not limited to, a nanoparticle or microparticle of albumin. In these examples the delivery of a pharmaceutically beneficial compound or mixture of compounds may benefit from alteration in the albumin's affinity to its receptor where the beneficial compound has been shown to associate with albumin for the means of delivery. It is not clear what determines the plasma half-life of the formed associates (for example but not limited to Levemir®, Kurtzhals P et al. Biochem. J. 1995; 312:725-731), conjugates or fusion polypeptides but it appears to be a result of the combination of the albumin and the selected pharmaceutically beneficial compound/polypeptide. It would be desirable to be able to control the plasma half-life of given albumin conjugates, associates or albumin fusion polypeptides so that a longer or shorter plasma half-life can be achieved than given by the components of the association, conjugation or fusion, in order to be able to design a particular drug according to the particulars of the indication intended to be treated.

Albumin is known to accumulate and be catabolised in tumours, it has also been shown to accumulate in inflamed joints of rheumatoid arthritis sufferers. See review article and reference therein, Kratz (2008) Journal of Controlled Release 132, 171-183. It is envisaged that HSA variants with increased affinity for FcRn would be advantageous for the delivery of pharmaceutically beneficial compounds.

It may even be desirable to have variants of albumin that have little or no binding to FcRn in order to provide shorter half-lives or controlled serum pharmacokinetics as described by Kenanova et al (2009) *J. Nucl. Med.;* 50 (Supplement 2):1582).

Kenanova et al (2010, Protein Engineering, Design & Selection 23(10): 789-798; WO2010/118169) discloses a docking model comprising a structural model of domain III of HSA (solved at pH 7 to 8) and a structural model of FcRn (solved at pH 6.4). Kenanova et al discloses that positions 464, 505, 510, 531 and 535 in domain III potentially interact with FcRn. The histidines at positions 464, 510 and 535 were identified as being of particular interest by Chaudhury et al., (2006, op. cit.) and these were shown to have a significant reduction in affinity and shorter half-life in mouse by Kenanova (2010, op. cit.). However, the studies of Kenanova et al are limited to domain III of HSA and therefore do not consider HSA in its native intact configuration. Furthermore, the identified positions result in a decrease in affinity for the FcRn receptor.

The present invention provides further variants having altered binding affinity to the FcRn receptor. The albumin moiety or moieties may therefore be used to tailor the binding affinity to FcRn and/or half-life of fusion polypeptides, conjugates, associates, nanoparticles and compositions comprising the albumin moiety.

SUMMARY OF THE INVENTION

The present invention relates to albumin variants comprising an alteration at positions corresponding to positions selected among two or more of the group consisting of positions 492, 550, 573, 574 and 580 of the mature polypeptide of SEQ ID NO: 2 or equivalent positions of other albumins or fragments thereof. Position 492 is located in the connector loop between subdomain DIIIa and subdomain DIIIb. Positions 550, 573, 574 and 580 are located in subdomain DIIIb. Subdomain DIIIb is located proximal to the connector loop between subdomain DIIIa and subdomain DIIIb.

The present invention also relates to isolated polynucleotides encoding the variants; nucleic acid constructs, vectors, and host cells comprising the polynucleotides; and methods of producing the variants.

The invention also relates to conjugates or associates comprising the variant albumin or fragment thereof according to the invention and a beneficial therapeutic moiety or to a fusion polypeptide comprising a variant albumin or fragment thereof of the invention and a fusion partner polypeptide.

The invention further relates to compositions comprising the variant albumin, fragment thereof, fusion polypeptide comprising variant albumin or fragment thereof or conjugates comprising the variant albumin or fragment thereof, according to the invention or associates comprising the variant albumin or fragment thereof, according to the invention. The compositions are preferably pharmaceutical compositions.

The invention further relates to a pharmaceutical composition comprising a variant albumin, fragment thereof, fusion polypeptide comprising variant albumin or fragment thereof or conjugates comprising the variant albumin or fragment thereof, or associates comprising the variant albumin or fragment thereof.

The invention also relates to the use of the variants, fragments, fusion polypeptides, conjugates, associates, nanoparticles and microparticles.

The invention also relates to a method for preparing a variant albumin, fragment thereof, fusion polypeptide comprising variant albumin or fragment thereof or conjugates comprising the variant albumin or fragment thereof, or associates comprising the variant albumin or fragment thereof.

BRIEF DESCRIPTION OF THE FIGURES

The patent or application file contains at least one drawing executed in color. Copies of this patent or patent application publication with color drawing(s) will be provided by the Office upon request and payment of the necessary fee.

FIG. 1: Multiple alignment of amino acid sequences of (i) full length mature HSA (Hu_1_2_3) (SEQ ID NO: 2), (ii) an albumin variant comprising domain I and domain III of HSA (Hu_1_3) (SEQ ID NO: 24), (iii) an albumin variant comprising domain II and domain III of HSA (Hu_2_3) (SEQ ID NO: 25), (iv) full-length *Macaca mulatta* albumin (Mac_mul) (SEQ ID NO: 6), (v) full-length *Rattus norvegicus* albumin (Rat)(SEQ ID NO: 10) and (vi) full-length *Mus musculus* albumin (Mouse) (SEQ ID NO: 9). Positions 500, 550 and 573 (relative to full length HSA) are indicated by arrows. In FIG. 1, Domains I, II and III are referred to as 1, 2 and 3 (respectively).

FIG. 2: Multiple alignment of amino acid sequences of mature albumin from human (SEQ ID NO: 2), sheep (SEQ ID NO: 16), mouse (SEQ ID NO: 9), rabbit (SEQ ID NO: 14) and goat (SEQ ID NO: 15) and immature albumins from chimpanzee ("Chimp") (SEQ ID NO: 5), macaque (SEQ ID NO: 6), hamster (SEQ ID NO: 7), guinea pig (SEQ ID NO: 8), rat (SEQ ID NO: 10), cow (SEQ ID NO: 11), horse (SEQ ID NO: 12), donkey (SEQ ID NO: 13), dog (SEQ ID NO: 17), chicken (SEQ ID NO: 18), and pig (SEQ ID NO: 19). The Start and End amino acids of domains 1, 2 and 3 (as defined by Dockal et al (The Journal of Biological Chemistry, 1999, Vol. 274(41): 29303-29310)) are indicated with respect to mature human albumin.

DEFINITIONS

Figure 3:
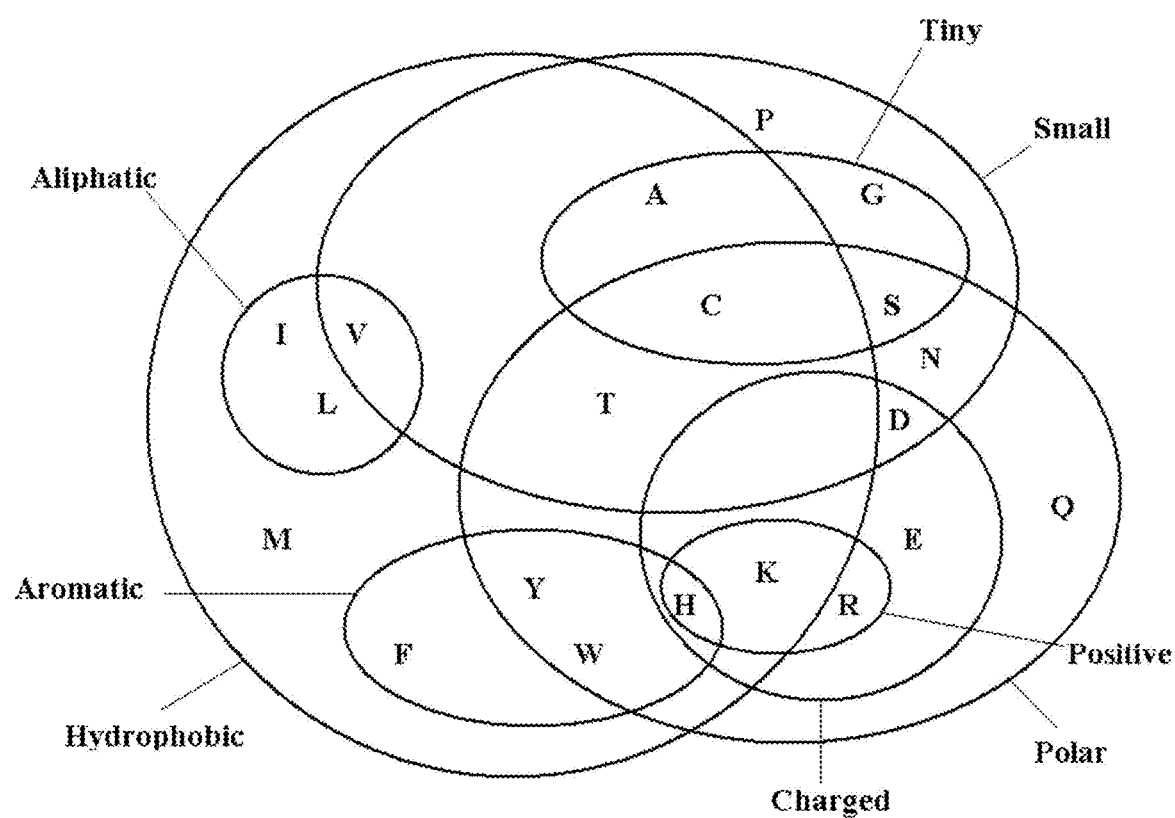
FIG. 3: Conserved groups of amino acids based on their properties.
Figure 4:
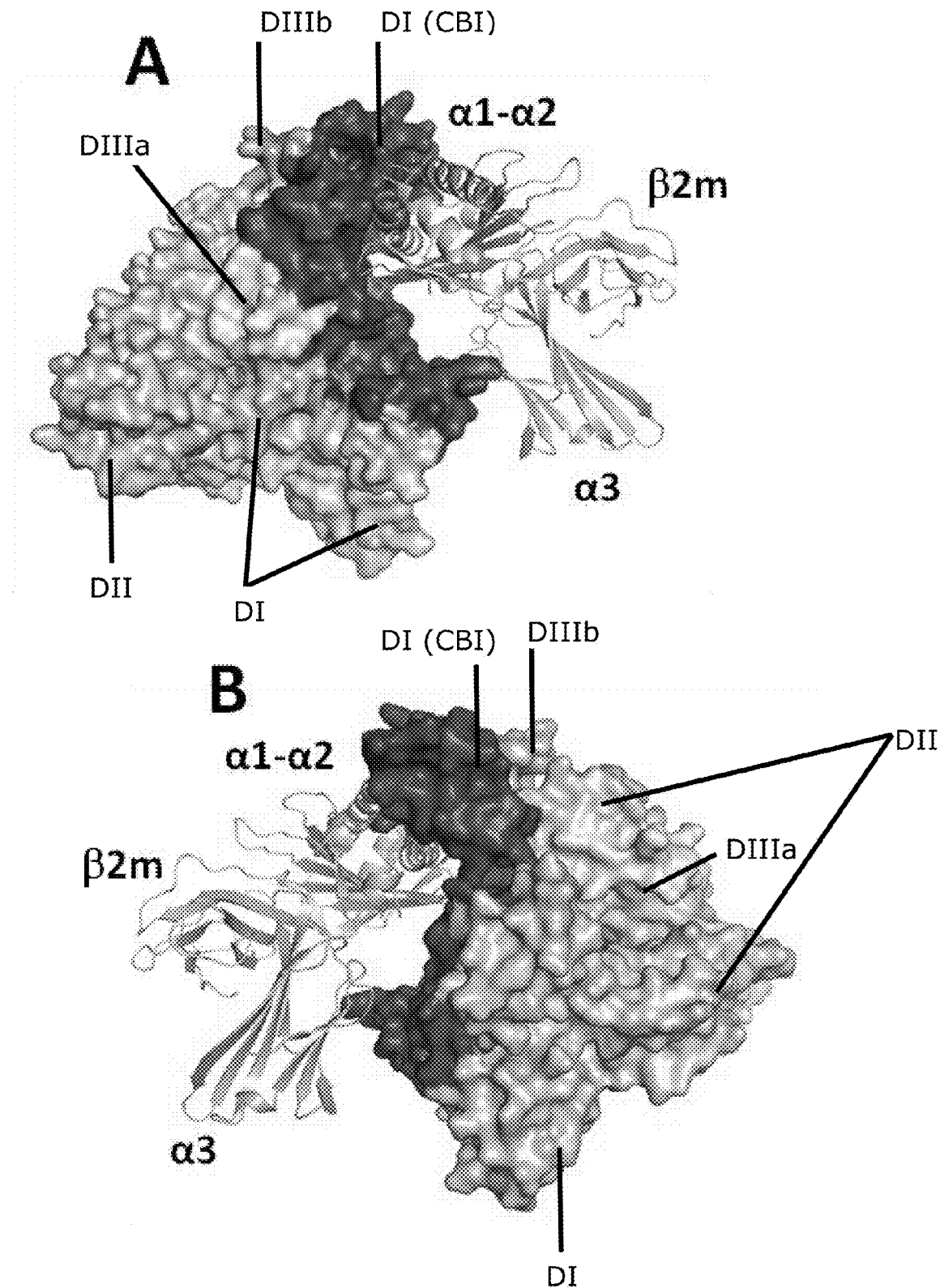
FIG. 4: Representation of shFcRn-HSA docking model. (A-B) Two orientations of the complex are shown. Albumin is shown by a space-filling diagram, FcRn is shown as a ribbon diagram. The core binding interface of HSA is highlighted in pink (in grey-scale this is seen as the darkest (almost black) region; DI (CBI)), while the area distally localized from the interface is shown as DII (orange) and DIII is split into sub-domains DIIIa (in colour, this is cyan) and DIIIb (in colour, this is blue).

Variant: The term "variant" means a polypeptide derived from a parent albumin by one or more (several) alteration(s), i.e., a substitution, insertion, and/or deletion, at one or more (several) positions. A substitution means a replacement of an amino acid occupying a position with a different amino acid; a deletion means removal of an amino acid occupying a position; and an insertion means adding 1 or more, such as 1, 2, 3, 4, 5, 6, 7, 8, 9 or 10, preferably 1-3 amino acids immediately adjacent an amino acid occupying a position. In relation to substitutions, 'immediately adjacent' may be to the N-side ('upstream') or C-side ('downstream') of the amino acid occupying a position ('the named amino acid'). Therefore, for an amino acid named/numbered 'X', the insertion may be at position 'X+1' ('downstream') or at position 'X−1' ('upstream').

Mutant: The term "mutant" means a polynucleotide encoding a variant.

Wild-Type Albumin: The term "wild-type" (WT) albumin means albumin having the same amino acid sequence as naturally found in an animal or in a human being.

Parent Albumin: The term "parent" or "parent albumin" means an albumin to which an alteration is made by the hand of man to produce the albumin variants of the invention. The parent may be a naturally occurring (wild-type) polypeptide or an allele thereof, or even a variant thereof.

Albumin: Albumins are proteins and constitute the most abundant protein in plasma in mammals and albumins from a long number of mammals have been characterized by biochemical methods and/or by sequence information. Several albumins, e.g., human serum albumin (HSA), have also been characterized crystallographically and the structure determined (HSA: He X M, Carter D C (July 1992). "Atomic structure and chemistry of human serum albumin". Nature 358 (6383): 209-15; horse albumin: Ho, J. X. et al. (2001). X-ray and primary structure of horse serum albumin (*Equus caballus*) at 0.27-nm resolution. Eur J Biochem. 215(1):205-12).

The term "albumin" means a protein having the same and/or very similar three dimensional (tertiary) structure as HSA or HSA domains and has similar properties to HSA or to the relevant domains. Similar three dimensional structures are for example the structures of the albumins from the species mentioned herein. Some of the major properties of albumin are i) its ability to regulate plasma volume (oncotic activity), ii) a long plasma half-life of around 19 days±5 days, iii) binding to FcRn, iv) ligand-binding, e.g. binding of endogenous molecules such as acidic, lipophilic compounds including bilirubin, fatty acids, hemin and thyroxine (see also table 1 of Kragh-Hansen et al, 2002, Biol. Pharm. Bull. 25, 695, hereby incorporated by reference), v) binding of small organic compounds with acidic or electronegative features e.g. drugs such as warfarin, diazepam, ibuprofen and paclitaxel (see also table 1 of Kragh-Hansen et al, 2002, Biol. Pharm. Bull. 25, 695, hereby incorporated by reference). Not all of these properties need to be fulfilled in order to characterize a protein or fragment as an albumin. If a fragment, for example, does not comprise a domain responsible for binding of certain ligands or organic compounds the variant of such a fragment will not be expected to have these properties either.

Albumins have generally a long plasma half-life of approximately 20 days or longer, e.g., HSA has a plasma half-life of 19 days. It is known that the long plasma half-life of HSA is mediated via interaction with its receptor FcRn, however, an understanding or knowledge of the exact mechanism behind the long half-life of HSA is not essential for the invention.

As examples of albumin proteins, more specifically albumin proteins which may be used as parent 'backbones' as a starting point for making the albumin variants according to the invention, can be mentioned human serum albumin (e.g. AAA98797 or P02768-1, SEQ ID NO: 2 (mature), SEQ ID NO: 4 (immature)), primate serum albumin, (such as chimpanzee serum albumin (e.g. predicted sequence XP_517233.2 SEQ ID NO: 5), gorilla serum albumin or macaque serum albumin (e.g. NP_001182578, SEQ ID NO: 6), rodent serum albumin (such as hamster serum albumin (e.g. A6YF56, SEQ ID NO: 7), guinea pig serum albumin (e.g. Q6WDN9-1, SEQ ID NO: 8), mouse serum albumin (e.g. AAH49971 or P07724-1 Version 3, SEQ ID NO: 9) and rat serum albumin (e.g. AAH85359 or P02770-1 Version 2, SEQ ID NO: 10))), bovine serum albumin (e.g. cow serum albumin P02769-1, SEQ ID NO: 11), equine serum albumin such as horse serum albumin (e.g. P35747-1, SEQ ID NO: 12) or donkey serum albumin (e.g. Q5XLE4-1, SEQ ID NO: 13), rabbit serum albumin (e.g. P49065-1 Version 2, SEQ ID NO: 14), goat serum albumin (e.g. ACF10391, SEQ ID NO: 15), sheep serum albumin (e.g. P14639-1, SEQ ID NO: 16), dog serum albumin (e.g. P49822-1, SEQ ID NO: 17), chicken serum albumin (e.g. P19121-1 Version 2, SEQ ID NO: 18) and pig serum albumin (e.g. P08835-1 Version 2, SEQ ID NO: 19) or a polypeptide having at least 70, 75, 80, 85, 90, 91, 92, 93, 94, 95, 96, 97, 98 or at least 99% amino acid identity to such an albumin. The parent or reference albumin may be an artificial variant such as HSA. K573P (SEQ ID NO: 3) or a chimeric albumin such as the N-terminal of HSA and the C-terminal of macaca albumin (SEQ ID NO: 20), N-terminal of HSA and the C-terminal of mouse albumin (SEQ ID NO: 21), N-terminal of HSA and the C-terminal of rabbit albumin (SEQ ID NO: 22), N-terminal of HSA and the C-terminal of sheep albumin (SEQ ID NO: 23).

Other examples of albumin, which are also included in the scope of this application, include ovalbumin (e.g. P01012.pro: chicken ovalbumin; O73860.pro: turkey ovalbumin).

HSA as disclosed in SEQ ID NO: 2 or any naturally occurring allele thereof, is the preferred parent albumin according to the invention. HSA is a protein consisting of 585 amino acid residues and has a molecular weight of 67 kDa. In its natural form it is not glycosylated. The skilled person will appreciate that natural alleles may exist having essentially the same properties as HSA but having one or more (several) amino acid changes compared to SEQ ID NO: 2, and the inventors also contemplate the use of such natural alleles as parent albumin according to the invention.

The parent albumin, a fragment thereof, or albumin part of a fusion polypeptide comprising albumin or a fragment thereof according to the invention preferably has a sequence identity to the sequence of HSA shown in SEQ ID NO: 2 of at least 60%, preferably at least 70%, preferably at least 80%, preferably at least 85%, preferably at least 86%, preferably at least 87%, preferably at least 88%, preferably at least 89%, preferably at least 90%, preferably at least 91%, preferably at least 92%, preferably at least 93%, preferably at least 94%, preferably at least 95%, more preferred at least 96%, more preferred at least 97%, more preferred at least 98% and most preferred at least 99%. It is preferred that the parent albumin maintains at least one of the major properties of albumin or a similar tertiary structure as an albumin, such as HSA. The sequence identity may be over the full-length of SEQ ID NO: 2 or over a molecule consisting or comprising of a fragment such as one or more (several) domains of SEQ ID NO: 2 such as a molecule consisting of or comprising domain III (e.g. SEQ ID NO: 27), a molecule consisting of or comprising domain II and domain III (e.g. SEQ ID NO: 25), a molecule consisting of or comprising domain I and domain III (e.g. SEQ ID NO: 24), a molecule consisting of or comprising two copies of domain III (e.g. SEQ ID NO: 26), a molecule consisting of or comprising three copies of domain III (e.g. SEQ ID NO: 28) or a molecule consisting of or comprising domain I and two copies of domain III (e.g. SEQ ID NO: 29).

The parent preferably comprises or consists of the amino acid sequence of SEQ ID NO: 4 (immature sequence of HSA) or SEQ ID NO: 2 (mature sequence of HSA).

In another embodiment, the parent is an allelic variant of the mature polypeptide of SEQ ID NO: 2.

The parent albumin may be encoded by a polynucleotide that hybridizes under very low stringency conditions, low stringency conditions, medium stringency conditions, medium-high stringency conditions, high stringency conditions, or very high stringency conditions with (i) the mature polypeptide coding sequence of SEQ ID NO: 1 or (ii) the full-length complementary strand of (i) (J. Sambrook, E. F. Fritsch, and T. Maniatis, 1989, *Molecular Cloning, A Laboratory Manual*, 2d edition, Cold Spring Harbor, N.Y.).

The polynucleotide of SEQ ID NO: 1 or a subsequence thereof, as well as the amino acid sequence of SEQ ID NO: 2 or a fragment thereof, may be used to design nucleic acid probes to identify and clone DNA encoding a parent from strains of different genera or species according to methods well known in the art. In particular, such probes can be used for hybridization with the genomic or cDNA of the genus or species of interest, following standard Southern blotting procedures, in order to identify and isolate the corresponding gene therein. Such probes can be considerably shorter than the entire sequence, but should be at least 14, e.g., at least 25, at least 35, or at least 70 nucleotides in length.

Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labelled for detecting the corresponding gene (for example, with $^{32}P$, $^{3}H$, $^{35}S$, biotin, or avidin). Such probes are encompassed by the invention.

A genomic DNA or cDNA library prepared from such other organisms may be screened for DNA that hybridizes with the probes described above and encodes a parent. Genomic or other DNA from such other organisms may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that is homologous with SEQ ID NO: 1 or a subsequence thereof, the carrier material is used in a Southern blot.

For purposes of the invention, hybridization indicates that the polynucleotide hybridizes to a labelled nucleotide probe corresponding to the polynucleotide shown in SEQ ID NO: 1, its complementary strand, or a subsequence thereof, under low to very high stringency conditions. Molecules to which the probe hybridizes can be detected using, for example, X-ray film or any other detection means known in the art.

The nucleic acid probe may comprise or consist of the mature polypeptide coding sequence of SEQ ID NO: 1, i.e. nucleotides 1 to 1785 of SEQ ID NO: 1. The nucleic acid probe may comprise or consist of a polynucleotide that encodes the polypeptide of SEQ ID NO: 2 or a fragment thereof.

For long probes of at least 100 nucleotides in length, very low to very high stringency conditions are defined as prehybridization and hybridization at 42° C. in 5×SSPE, 0.3% SDS, 200 micrograms/ml sheared and denatured salmon sperm DNA, and either 25% formamide for very low and low stringencies, 35% formamide for medium and medium-high stringencies, or 50% formamide for high and very high stringencies, following standard Southern blotting procedures for 12 to 24 hours optimally. The carrier material is finally washed three times each for 15 minutes using 2×SSC, 0.2% SDS at 45° C. (very low stringency), 50° C. (low stringency), 55° C. (medium stringency), 60° C. (medium-high stringency), 65° C. (high stringency), or 70° C. (very high stringency).

For short probes that are about 15 nucleotides to about 70 nucleotides in length, stringency conditions are defined as pre-hybridization and hybridization at about 5° C. to about 10° C. below the calculated $T_m$ using the calculation according to Bolton and McCarthy (1962, *Proc. Natl. Acad. Sci. USA* 48: 1390) in 0.9 M NaCl, 0.09 M Tris-HCl pH 7.6, 6 mM EDTA, 0.5% NP-40, 1×Denhardt's solution, 1 mM sodium pyrophosphate, 1 mM sodium monobasic phosphate, 0.1 mM ATP, and 0.2 mg of yeast RNA per ml following standard Southern blotting procedures for 12 to 24 hours optimally. The carrier material is finally washed once in 6×SCC plus 0.1% SDS for 15 minutes and twice each for 15 minutes using 6×SSC at 5° C. to 10° C. below the calculated $T_m$.

The parent may be encoded by a polynucleotide with a sequence identity to the mature polypeptide coding sequence of SEQ ID NO: 1 of at least 60%, e.g., at least 65%, at least 70%, at least 75%, at least 80%, at least 85%, at least 90%, at least 95%, at least 96%, at least 97%, at least 98%, at least 99%, or 100%, which encodes a polypeptide which is able to function as an albumin. In an embodiment, the parent is encoded by a polynucleotide comprising or consisting of SEQ ID NO: 1.

Albumin moiety: The albumin part of a fusion polypeptide, conjugate, associate, nanoparticle or composition comprising the albumin variant or fragment thereof according to the invention, may be referred to as an 'albumin moiety' or 'albumin component'. A polypeptide according to the invention may comprise or consist of an albumin moiety.

FcRn and shFcRn: The term "FcRn" means the human neonatal Fc receptor (FcRn). shFcRn is a soluble recombinant form of FcRn. hFcRn is a heterodimer of SEQ ID NO: 30 (truncated heavy chain of the major histocompatibility complex class I-like Fc receptor (FCGRT)) and SEQ ID NO: 31 (beta-2-microglobulin). Together, SEQ ID NO: 30 and 31 form hFcRn.

Isolated variant: The term "isolated variant" means a variant in a form or environment which does not occur in nature. Non-limiting examples of isolated variants include (1) any non-naturally occurring variant, (2) any variant that is at least partially removed from one or more (several) or all of the naturally occurring constituents with which it is associated in nature; (3) any variant modified by the hand of man relative to the polypeptide from which it is derived (e.g. the polypeptide from which it is derived as found in nature); or (4) any variant modified by increasing the amount of the variant e relative to other components with which it is naturally associated (e.g., multiple copies of a gene encoding the substance; use of a stronger promoter than the promoter naturally associated with the gene encoding the substance). An isolated variant may be present in a fermentation broth sample.

Substantially pure variant: The term "substantially pure variant" means a preparation that contains at most 10%, at most 8%, at most 6%, at most 5%, at most 4%, at most 3%, at most 2%, at most 1%, and at most 0.5% by weight of other polypeptide material with which it is natively or recombinantly associated. Preferably, the variant is at least 92% pure, e.g., at least 94% pure, at least 95% pure, at least 96% pure, at least 97% pure, at least 98% pure, at least 99%, at least 99.5% pure, and 100% pure by weight of the total polypeptide material present in the preparation. Purity may be determined by SDS-PAGE or GP-HPLC. The variants of the invention are preferably in a substantially pure form. This can be accomplished, for example, by preparing the variant by well-known recombinant methods and by purification methods.

Mature polypeptide: The term "mature polypeptide" means a polypeptide in its final form following translation and any post-translational modifications, such as N-terminal processing, C-terminal truncation, glycosylation, phosphorylation, etc. The mature polypeptide may be amino acids 1 to 585 of SEQ ID NO: 2, e.g. with the inclusion of alterations according to the invention and/or any post-translational modifications.

Mature polypeptide coding sequence: The term "mature polypeptide coding sequence" means a polynucleotide that encodes a mature albumin polypeptide. The mature polypeptide coding sequence may be nucleotides 1 to 1758 of SEQ ID NO: 1 e.g. with the alterations required to encode a variant according to the invention.

Sequence Identity:

The relatedness between two amino acid sequences or between two nucleotide sequences is described by the parameter "sequence identity".

For purposes of the present invention, the sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix. The output of Needle labeled "longest identity" (obtained using the—nobrief option) is used as the percent identity and is calculated as follows:

(Identical Residues×100)/(Length of Alignment–
Total Number of Gaps in Alignment)

For purposes of the present invention, the sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 5.0.0 or later. The parameters used are gap open penalty of 10, gap extension penalty of 0.5, and the EDNAFULL (EMBOSS version of NCBI NUC4.4) substitution matrix. The output of Needle labeled "longest identity" (obtained using the—nobrief option) is used as the percent identity and is calculated as follows:

(Identical Deoxyribonucleotides×100)/(Length of
Alignment–Total Number of Gaps in Alignment)

Fragment: The term "fragment" means a polypeptide having one or more (several) amino acids deleted from the amino and/or carboxyl terminus of an albumin and/or an internal region of albumin that has retained the ability to bind to FcRn. Fragments may consist of one uninterrupted sequence derived from HSA or it may comprise two or more sequences derived from HSA. The fragments according to the invention have a size of more than approximately 20 amino acid residues, preferably more than 30 amino acid residues, more preferred more than 40 amino acid residues, more preferred more than 50 amino acid residues, more preferred more than 75 amino acid residues, more preferred more than 100 amino acid residues, more preferred more than 200 amino acid residues, more preferred more than 300 amino acid residues, even more preferred more than 400 amino acid residues and most preferred more than 500 amino acid residues. A fragment may comprise or consist of one more domains of albumin such as DI+DII, DI+DIII, DII+DIII, DIII+DIII, DI+DIII+DIII, DIII+DIII+DIII, or fragments of such domains or combinations of domains.

Domains I, II and III may be defined with reference to HSA (SEQ ID NO: 2). For example, HSA domain I may consist of or comprise amino acids 1 to 194 (±1 to 15 amino acids) of SEQ ID NO: 2, HSA domain II may consist of or comprise amino acids 192 (±1 to 15 amino acids) to 387 (±1 to 15 amino acids) of SEQ ID NO: 2 and domain III may consist of or comprise amino acid residues 381 (±1 to 15 amino acids) to 585 (±1 to 15 amino acids) of SEQ ID NO: 2. "±1 to 15 amino acids" means that the residue number may deviate by 1, 2, 3, 4, 5, 6, 7, 8, 9, 10, 11, 12, 13, 14, or 15 amino acids to the C-terminus and/or to the N-terminus of the stated amino acid position. Examples of domains I, II and III are described by Dockal et al (The Journal of Biological Chemistry, 1999, Vol. 274(41): 29303-29310) and Kjeldsen et al (Protein Expression and Purification, 1998, Vol 13: 163-169) and are tabulated below.

| Amino acid residues of HSA domains I, II and III with reference to SEQ ID NO: 2 | Dockal et al | Kjeldsen et al |
|---|---|---|
| Domain I | 1 to 197 | 1 to 192 |
| Domain II | 189 to 385 | 193 to 382 |
| Domain III | 381 to 585 | 383 to 585 |

The skilled person can identify domains I, II and III in non-human albumins by amino acid sequence alignment with HSA, for example using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 3.0.0 or later. The optional parameters used are gap open penalty of 10, gap extension penalty of 0.5, and the EBLOSUM62 (EMBOSS version of BLOSUM62) substitution matrix. Other suitable software includes MUSCLE ((Multiple sequence comparison by log-expectation, Robert C. Edgar, Version 3.6, http://www.drive5.com/muscle; Edgar (2004) Nucleic Acids Research 32(5), 1792-97 and Edgar (2004) BMC Bioinformatics, 5(1):113) which may be used with the default settings as described in the User Guide (Version 3.6, September 2005). Versions of MUSCLE later than 3.6 may also be used for any aspect of the invention). Examples of suitable alignments are provided in FIGS. 1 and 2.

It is preferred that domains have at least 70, 75, 80, 85, 90, 95, 96, 97, 98, 99, 99.5% identity or 100% identity to Domain I, II or III of HSA (SEQ ID NO: 2).

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Coding sequence: The term "coding sequence" means a polynucleotide, which directly specifies the amino acid sequence of its translated polypeptide product. The boundaries of the coding sequence are generally determined by an open reading frame, which usually begins with the ATG start codon or alternative start codons such as GTG and TTG and ends with a stop codon such as TAA, TAG, and TGA. The coding sequence may be a DNA, cDNA, synthetic, or recombinant polynucleotide.

cDNA: The term "cDNA" means a DNA molecule that can be prepared by reverse transcription from a mature, spliced, mRNA molecule obtained from a eukaryotic cell. cDNA lacks intron sequences that may be present in the corresponding genomic DNA. The initial, primary RNA transcript is a precursor to mRNA that is processed through a series of steps, including splicing, before appearing as mature spliced mRNA.

Nucleic acid construct: The term "nucleic acid construct" means a nucleic acid molecule, either single- or double-stranded, which is isolated from a naturally occurring gene or is modified to contain segments of nucleic acids in a manner that would not otherwise exist in nature or which is synthetic. The term nucleic acid construct is synonymous with the term "expression cassette" when the nucleic acid construct contains the control sequences required for expression of a coding sequence of the invention.

Control sequences: The term "control sequences" means all nucleic acid sequences necessary for the expression of a polynucleotide encoding a variant of the invention. Each control sequence may be native (i.e. from the same gene) or foreign (i.e. from a different gene) to the polynucleotide encoding the variant or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a variant.

Operably linked: The term "operably linked" means a configuration in which a control sequence is placed at an appropriate position relative to the coding sequence of a polynucleotide such that the control sequence directs the expression of the coding sequence.

Expression: The term "expression" includes any step involved in the production of the variant including, but not limited to, transcription, post-transcriptional modification, translation, post-translational modification, and secretion.

Expression vector: The term "expression vector" means a linear or circular DNA molecule that comprises a polynucleotide encoding a variant and is operably linked to control sequences that provide for its expression.

Host cell: The term "host cell" means any cell type that is susceptible to transformation, transfection, transduction, or the like with a nucleic acid construct or expression vector comprising a polynucleotide of the present invention. The term "host cell" encompasses any progeny of a parent cell that is not identical to the parent cell due to mutations that occur during replication.

Plasma half-life: Plasma half-life is ideally determined in vivo in suitable individuals. However, since it is time consuming and expensive and there inevitable are ethical concerns connected with doing experiments in animals or man it is desirable to use an in vitro assay for determining whether plasma half-life is extended or reduced. It is known that the binding of albumin to its receptor FcRn is important for plasma half-life and the correlation between receptor binding and plasma half-life is that a higher affinity of albumin to its receptor leads to longer plasma half-life. Thus for the invention a higher affinity of albumin to FcRn is considered indicative of an increased plasma half-life and a lower affinity of albumin to its receptor is considered indicative of a reduced plasma half-life.

In this application and claims the binding of albumin to its receptor FcRn is described using the term affinity and the expressions "stronger" or "weaker". Thus, it should be understood that a molecule having a higher affinity to FcRn than HSA is considered to bind stronger to FcRn than HSA and a molecule having a lower affinity to FcRn than HSA is considered to bind weaker to FcRn than HSA.

The terms "longer plasma half-life" or "shorter plasma half-life" and similar expressions are understood to be in relationship to the corresponding parent or reference or corresponding albumin molecule. Thus, a longer plasma half-life with respect to a variant albumin of the invention means that the variant has longer plasma half-life than the corresponding albumin having the same sequences except for the alteration(s) described herein, e.g. at two or more positions corresponding to 492, 550, 573, 574 and 580 of HSA (SEQ ID NO: 2).

Reference: a reference is an albumin, fusion, conjugate, composition, associate or nanoparticle to which an albumin variant, fusion, conjugate, composition, associate or nanoparticle is compared. The reference may comprise or consist of full length albumin (such as HSA or a natural allele thereof) or a fragment thereof. A reference may also be referred to as a 'corresponding' albumin, fusion, conjugate, composition, associate or nanoparticle to which an albumin variant, fusion, conjugate, composition, associate or nanoparticle is compared. A reference may comprise or consist of HSA (SEQ ID NO: 2) or a fragment, fusion, conjugate, associate, nanoparticle or microparticle thereof. Preferably, the reference is identical to the polypeptide, fusion polypeptide, conjugate, composition, associate, nanoparticle or microparticle according to the invention ("being studied") with the exception of the albumin moiety. Preferably the albumin moiety of the reference comprises or consists of an albumin (e.g. HSA, SEQ ID NO: 2) or a fragment thereof. The amino acid sequence of the albumin moiety of the reference may be longer than, shorter than or, preferably, the same (±1 to 15 amino acids) length as the amino sequence of the albumin moiety of the polypeptide, fusion polypeptide, conjugate, composition, associate, nanoparticle or microparticle according to the invention ("being studied").

Equivalent amino acid positions: Throughout this specification amino acid positions are defined in relation to full-length mature human serum albumin (i.e. without leader sequence, SEQ ID NO: 2). However, the skilled person understands that the invention also relates to variants of non-human albumins (e.g. those disclosed herein) and/or fragments of a human or non-human albumin. Equivalent positions can be identified in fragments of human serum albumin, in animal albumins and in fragments, fusions and other derivative or variants thereof by comparing amino acid sequences using pairwise (e.g. ClustalW) or multiple (e.g. MUSCLE) alignments. For example, FIG. 1 shows that positions equivalent to 500, 550 and 573 in full length human serum albumin are easily identified in fragments of human serum albumin and in albumins of other species. Positions 500, 550 and 573 are indicated by arrows. Further details are provided in Table 1 below.

consensus line; Fraction of sequences (that must agree for shading): 0.5; Input sequence format: ALN. Therefore, throughout this specification amino acid positions defined in human serum albumin also apply to equivalent positions in fragments, derivatives or variants and fusions of human serum albumin, animals from other species and fragments and fusions thereof. Such equivalent positions may have (i) a different residue number in its native protein and/or (ii) a different native amino acid in its native protein.

Likewise, FIG. 2 shows that equivalent positions can be identified in fragments (e.g. domains) of an albumin with reference to SEQ ID NO: 2 (HSA).

Conventions for Designation of Variants

For purposes of the present invention, the mature polypeptide disclosed in SEQ ID NO: 2 is used to determine the corresponding amino acid residue in another albumin. The amino acid sequence of another albumin is aligned with the mature polypeptide disclosed in SEQ ID NO: 2, and based on the alignment, the amino acid position number corresponding to any amino acid residue in the mature polypeptide disclosed in SEQ ID NO: 2 is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix.

Identification of the corresponding amino acid residue in another albumin can be determined or confirmed by an alignment of multiple polypeptide sequences using several computer programs including, but not limited to, MUSCLE (multiple sequence comparison by log-expectation; version 3.5 or later; Edgar, 2004, *Nucleic Acids Research* 32: 1792-1797), MAFFT (version 6.857 or later; Katoh and Kuma, 2002, *Nucleic Acids Research* 30: 3059-3066; Katoh et al., 2005, *Nucleic Acids Research* 33: 511-518; Katoh and Toh, 2007, *Bioinformatics* 23: 372-374; Katoh et al., 2009, *Methods in Molecular Biology* 537:_39-64; Katoh and Toh, 2010, *Bioinformatics* 26:_1899-1900), and EMBOSS EMMA

TABLE 1

Example of identification of equivalent positions in HSA, animal albumins and albumin fragments

| Organism (accession number of protein) | Albumin | | Total length of mature protein | Position equivalent to human serum albumin (native amino acid): | | |
|---|---|---|---|---|---|---|
| | Full length or fragment | Fragment details | | 500 (K) | 550 (D) | 573 (K) |
| Homo sapiens (AAA98797) | Full length | — | 585 | 500 (K) | 550 (D) | 573 (K) |
| Homo sapiens | Fragment | DI, DIII | 399 | 314 (K) | 364 (D) | 387 (K) |
| Homo sapiens | Fragment | DI, DIII | 403 | 318 (K) | 368 (D) | 391 (K) |
| Macaca mulatta (NP_001182578) | Full length | — | 584 | 500 (K) | 550 (N) | 573 (P) |
| Rattus norvegicus (AAH85359) | Full length | — | 584 | 500 (K) | 550 (D) | 573 (P) |
| Mus musculus (AAH49971) | Full length | — | 584 | 500 (K) | 550 (D) | 573 (P) |

FIG. 1 was generated by MUSCLE using the default parameters including output in ClustalW 1.81 format. The raw output data was shaded using BoxShade 3.21 (http://www.ch.embnet.org/software/BOX_form.html) using Output Format: RTF_new; Font Size: 10; Consensus Line: no employing ClustalW (1.83 or later; Thompson et al., 1994, *Nucleic Acids Research* 22: 4673-4680), using their respective default parameters.

When the other polypeptide (or protein) has diverged from the mature polypeptide of SEQ ID NO: 2 such that traditional sequence-based comparison fails to detect their relationship (Lindahl and Elofsson, 2000, *J. Mol. Biol.* 295: 613-615), other pairwise sequence comparison algorithms can be used. Greater sensitivity in sequence-based searching can be attained using search programs that utilize probabilistic representations of polypeptide families (profiles) to search databases. For example, the PSI-BLAST program generates profiles through an iterative database search process and is capable of detecting remote homologs (Atschul et al., 1997, *Nucleic Acids Res.* 25: 3389-3402). Even greater sensitivity can be achieved if the family or superfamily for the polypeptide has one or more representatives in the protein structure databases. Programs such as Gen-THREADER (Jones, 1999, *J. Mol. Biol.* 287: 797-815; McGuffin and Jones, 2003, *Bioinformatics* 19: 874-881) utilize information from a variety of sources (PSI-BLAST, secondary structure prediction, structural alignment profiles, and solvation potentials) as input to a neural network that predicts the structural fold for a query sequence. Similarly, the method of Gough et al., 2000, *J. Mol. Biol.* 313: 903-919, can be used to align a sequence of unknown structure with the superfamily models present in the SCOP database. These alignments can in turn be used to generate homology models for the polypeptide, and such models can be assessed for accuracy using a variety of tools developed for that purpose.

For proteins of known structure, several tools and resources are available for retrieving and generating structural alignments. For example the SCOP superfamilies of proteins have been structurally aligned, and those alignments are accessible and downloadable. Two or more protein structures can be aligned using a variety of algorithms such as the distance alignment matrix (Holm and Sander, 1998, *Proteins* 33: 88-96) or combinatorial extension (Shindyalov and Bourne, 1998, *Protein Engineering* 11: 739-747), and implementation of these algorithms can additionally be utilized to query structure databases with a structure of interest in order to discover possible structural homologs (e.g., Holm and Park, 2000, *Bioinformatics* 16: 566-567).

In describing the albumin variants of the present invention, the nomenclature described below is adapted for ease of reference. The accepted IUPAC single letter or three letter amino acid abbreviation is employed. The term 'point mutation' and/or 'alteration' includes deletions, insertions and substitutions.

Substitutions. For an amino acid substitution, the following nomenclature is used: Original amino acid, position, substituted amino acid. Accordingly, the substitution of threonine at position 226 with alanine is designated as "Thr226Ala" or "T226A". Multiple mutations (or alterations) are separated by addition marks ("+"), e.g., "Gly205Arg+Ser411Phe" or "G205R+S411F", representing substitutions at positions 205 and 411 of glycine (G) with arginine (R) and serine (S) with phenylalanine (F), respectively. The Figures also use ("/"), e.g., "E492T/N503D" this should be viewed as interchangeable with ("+").

Deletions. For an amino acid deletion, the following nomenclature is used: Original amino acid, position*. Accordingly, the deletion of glycine at position 195 is designated as "Gly195*" or "G195*". Multiple deletions are separated by addition marks ("+"), e.g., "Gly195*+Ser411*" or "G195*+S411*".

Insertions. As disclosed above, an insertion may be to the N-side ('upstream', 'X−1') or C-side ('downstream', 'X+1') of the amino acid occupying a position ('the named (or original) amino acid', 'X').

For an amino acid insertion to the C-side ('downstream', 'X+1') of the original amino acid ('X'), the following nomenclature is used: Original amino acid, position, original amino acid, inserted amino acid. Accordingly the insertion of lysine after glycine at position 195 is designated "Gly195GlyLys" or "G195GK". An insertion of multiple amino acids is designated [Original amino acid, position, original amino acid, inserted amino acid #1, inserted amino acid #2; etc.]. For example, the insertion of lysine and alanine after glycine at position 195 is indicated as "Gly195GlyLysAla" or "G195GKA".

In such cases the inserted amino acid residue(s) are numbered by the addition of lower case letters to the position number of the amino acid residue preceding the inserted amino acid residue(s). In the above example, the sequence would thus be:

| Parent: | Variant: |
|---|---|
| 195 | 195 195a 195b |
| G | G - K - A |

For an amino acid insertion to the N-side ('upstream', 'X−1') of the original amino acid (X), the following nomenclature is used: Original amino acid, position, inserted amino acid, original amino acid. Accordingly the insertion of lysine (K) before glycine (G) at position 195 is designated "Gly195LysGly" or "G195KG". An insertion of multiple amino acids is designated [Original amino acid, position, inserted amino acid #1, inserted amino acid #2; etc., original amino acid]. For example, the insertion of lysine (K) and alanine (A) before glycine at position 195 is indicated as "Gly195LysAlaGly" or "G195KAG". In such cases the inserted amino acid residue(s) are numbered by the addition of lower case letters with prime to the position number of the amino acid residue following the inserted amino acid residue(s). In the above example, the sequence would thus be:

| Parent: | Variant: |
|---|---|
| 195 | 195a' 195b' 195 |
| G | K - A - G |

Multiple alterations. Variants comprising multiple alterations are separated by addition marks ("+"), e.g., "Arg170Tyr+Gly195Glu" or "R170Y+G195E" representing a substitution of arginine and glycine at positions 170 and 195 tyrosine and glutamic acid, respectively.

Different alterations. Where different alterations can be introduced at a position, the different alterations are separated by a comma, e.g., "Arg170Tyr,Glu" represents a substitution of arginine at position 170 with tyrosine or glutamic acid. Thus, "Tyr167Gly,Ala+Arg170Gly,Ala" designates the following variants:

"Tyr167Gly+Arg170Gly", "Tyr167Gly+Arg170Ala", "Tyr-167Ala+Arg170Gly", and "Tyr167Ala+Arg170Ala".

DETAILED DESCRIPTION OF THE INVENTION

The present invention relates to albumin variants, comprising an alteration at two or more positions selected among the group consisting of positions 492, 550, 573, 574 and 580 of the mature polypeptide of SEQ ID NO: 2, or at equivalent positions in other albumins or fragments thereof.

Variants

A first aspect of the invention provides polypeptides which are variant albumins or fragments thereof, or fusion polypeptides comprising the variant albumin or fragments thereof, of a parent albumin, comprising alterations at two or more positions corresponding to positions selected among the group consisting of positions 492, 550, 573, 574 and 580 of the mature polypeptide of SEQ ID NO: 2. It is preferred that the two or more alterations comprise alterations at positions corresponding to the following positions in SEQ ID NO: 2:

(a) 492 and 580; and/or
(b) 492 and 574; and/or
(c) 492 and 550; and/or
(d) 550 and 573; and/or
(e) 550 and 574; and/or
(f) 550 and 580; and/or
and/or that
(g) the two or more alterations comprise:
  an alteration to generate at a position corresponding to position 492 of SEQ ID NO: 2 an amino acid from the group consisting of A, C, D, F, H, I, K, L, M, N, P, Q, R, S, T, V, W, Y, preferably D and an alteration to generate at a position corresponding to position 573 of SEQ ID NO: 2 to an amino acid from the group consisting of C, D, E, F, G, H, I, L, M, N, Q, R, S, T, V, W, Y, preferably Y, W or H or
  an alteration to generate at a position corresponding to position 492 of SEQ ID NO: 2 a G and an alteration to generate at a position corresponding to position 573 an A or P and an additional alteration at a position selected from the group consisting of 550, 574 and 580; and/or
(h) the two or more alterations comprise:
  an alteration to generate at a position corresponding to position 573 of SEQ ID NO: 2 an amino acid from the group consisting of A, C, D, E, F, G, H, I, L, M, N, Q, R, S, T, V, W, Y, preferably Y, W or H and an alteration to generate at a position corresponding to position 574 of SEQ ID NO: 2 an amino acid from the group consisting of A, C, D, E, F, G, H, I, L, M, P, Q, R, S, T, V, W, Y, H, D, F, G, N, S or Y, more preferably H, D, F or G, most preferably H or
  an alteration to generate at a position corresponding to position 573 of SEQ ID NO: 2 a P and an alteration to generate at a position corresponding to position 574 of SEQ ID NO: 2 an N and an additional alteration at a position selected from the group consisting of 492, 550, and 580; and/or
(i) the two or more alterations comprise:
  an alteration to generate at a position corresponding to position 573 of SEQ ID NO: 2 an amino acid from the group consisting of A, C, D, E, F, G, H, I, L, M, N, Q, R, S, T, V, W, Y, preferably Y, W or H and an alteration to generate at a position corresponding to position 580 of SEQ ID NO: 2 an amino acid from the group consisting of C, D, E, F, G, H, I, L, M, N, P, R, S, T, V, W, Y or
  an alteration to generate at a position corresponding to position 573 of SEQ ID NO: 2 a P and an alteration to generate at a position corresponding to position 580 of SEQ ID NO: 2 a K and an additional alteration at a position selected from the group consisting of 492, 550, and 574; and/or
(j) the two or more alterations comprise:
  an alteration to generate at a position corresponding to position 574 of SEQ ID NO: 2 an amino acid from the group consisting of A, C, D, E, F, G, H, I, L, M, P, Q, R, S, T, V, W, Y, H, D, F, G, N, S or Y, more preferably H and an alteration to generate at a position corresponding to position 580 of SEQ ID NO: 2 to an amino acid from the group consisting of A, C, D, E, F, G, H, I, L, M, N, P, R, S, T, V, W, Y or
  an alteration to generate at a position corresponding to position 574 of SEQ ID NO: 2 an N and an alteration to generate at a position corresponding to position 580 of SEQ ID NO: 2 a K and an additional alteration at a position selected from the group consisting of 492, 550, and 573

The polypeptide may comprise, three or more, four or more or five or more alterations as described in paragraphs (a), (b), (c), (d), (e), (f), (g), (h), (i) and (j).

A preferred alteration is a substitution.

It is preferred that the parent albumin and/or the variant albumin comprises or consists of:

(a) a polypeptide having at least 60% sequence identity to the mature polypeptide of SEQ ID NO: 2;
(b) a polypeptide encoded by a polynucleotide that hybridizes under low stringency conditions with (i) the mature polypeptide coding sequence of SEQ ID NO: 1, or (ii) the full-length complement of (i);
(c) a polypeptide encoded by a polynucleotide having at least 60% identity to the mature mature polypeptide coding sequence of SEQ ID NO: 1; and/or
(d) a fragment of the mature polypeptide of SEQ ID NO: 2.

The variants of albumin or fragments thereof or fusion polypeptides comprising albumin or fragments thereof comprise alterations, such as substitutions, deletions or insertions at two or more of positions selected among the group consisting of positions 492, 550, 573, 574 and 580 of the mature polypeptide of SEQ ID NO: 2 or in equivalent positions of other albumins or variants or fragments thereof. A stop codon may be introduced in addition to the alterations described herein and if introduced is at position 574 or further downstream (e.g. in SEQ ID NO: 2 it is introduced at from position 574 to 585).

The variant albumin, a fragment thereof, or albumin part of a fusion polypeptide comprising variant albumin or a fragment thereof according to the invention has generally a sequence identity to the sequence of HSA shown in SEQ ID NO: 2 of at least 60%, preferably at least 70%, preferably at least 80%, preferably at least 85%, preferably at least 90%, more preferred at least 95%, more preferred at least 96%, more preferred at least 97%, more preferred at least 98% and most preferred at least 99%. The variant has less than 100% identity to SEQ ID NO: 2.

The variant albumin, a fragment thereof, or albumin part of a fusion polypeptide comprising variant albumin or a fragment thereof according to the invention has generally a sequence identity to the sequence of the parent albumin of at least 60%, preferably at least 70%, preferably at least 80%, preferably at least 85%, preferably at least 90%, more preferred at least 95%, more preferred at least 96%, more preferred at least 97%, more preferred at least 98% and most preferred at least 99%. The variant has less than 100% identity to the sequence of the parent albumin.

In one aspect, the number of alterations in the variants of the invention is 1 to 20, e.g., 1 to 10 and 1 to 5, such as 1, 2, 3, 4, 5, 6, 7, 8, 9 or 10 alterations relative to SEQ ID NO: 2 or relative to the sequence of the parent albumin.

At position 492 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to G, D, F, H, M or R, even more preferred to G, or D and most preferred to G. In SEQ ID NO: 2 the native amino acid at position 492 is E, therefore a substitution to E is not preferred.

At position 550 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to K, L, M, E or R, even more preferred to K, L or M and most preferred to K. In SEQ ID NO: 2 the native amino acid at position 550 is D, therefore a substitution to D is not preferred.

At position 573 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to P, Y, W, H, F, T, I or V, even more preferred to P, Y or W and most preferred to P. In SEQ ID NO: 2 the native amino acid at position 573 is K, therefore a substitution to K is not preferred.

At position 574 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to H, G, D, F, N, S or Y, even more preferred to D, F, G or H and most preferred to H. In SEQ ID NO: 2 the native amino acid at position 574 is K, therefore a substitution to K is not preferred.

At position 580 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to K or R, most preferred to K. In SEQ ID NO: 2 the native amino acid at position 580 is Q, therefore a substitution to Q is not preferred.

A variant albumin may comprise alterations at positions corresponding to positions 492+550 of SEQ ID NO: 2 (or equivalent position of other albumins or variants or fragments thereof). Such alterations may comprise 492D+550K (e.g. SEQ ID NO: 231), or 492G+550K (e.g. SEQ ID NO: 240).

A variant albumin may comprise alterations at positions corresponding to positions 492+573 of SEQ ID NO: 2 (or equivalent position of other albumins or variants or fragments thereof). Such alterations may comprise 492F+573P (e.g. SEQ ID NO: 109), 492G+573P (e.g. SEQ ID NO: 110), 492H+573P (e.g. SEQ ID NO: 111) or 492R+573P (e.g. SEQ ID NO: 113) or more preferably 492D+573P (e.g. SEQ ID NO: 108). However, it is preferred that the variant does not consist of SEQ ID NO: 2 with only alterations 492G+573A, 492G+573A, 492G+N503K+573A, 492G+N503H+573A, 492G+573P, 492G+N503K+573P or 492G+N503H+573P.

A variant albumin may comprise alterations at positions corresponding to positions 492+574 of SEQ ID NO: 2 (or equivalent position of other albumins or variants or fragments thereof). Such alterations may comprise 492D+574H (e.g. SEQ ID NO: 232), 492G+574H (e.g. SEQ ID NO: 241) or 492D+574H (e.g. SEQ ID NO: 232).

A variant albumin may comprise alterations at positions corresponding to positions 492+580 of SEQ ID NO: 2 (or equivalent position of other albumins or variants or fragments thereof).

A variant albumin may comprise alterations at positions corresponding to positions 550+573 of SEQ ID NO: 2 (or equivalent position of other albumins or variants or fragments thereof). Such alterations may comprise 550K+573P (e.g. SEQ ID NO: 117).

A variant albumin may comprise alterations at positions corresponding to positions 550+574 of SEQ ID NO: 2 (or equivalent position of other albumins or variants or fragments thereof). Such alterations may comprise 550K+574H (e.g. SEQ ID NO: 130), 550M+574H (e.g. SEQ ID NO: 249), 550M+574H (e.g. SEQ ID NO: 249) or 550L+574H (e.g. SEQ ID NO: 245).

A variant albumin may comprise alterations at positions corresponding to positions 550+580 of SEQ ID NO: 2 (or equivalent position of other albumins or variants or fragments thereof). Such alterations may comprise 550K+580K (e.g. SEQ ID NO: 131), 550M+580K (e.g. SEQ ID NO: 251) or 550L+580K (e.g. SEQ ID NO: 247).

A variant albumin may comprise alterations at positions corresponding to positions 573+574 of SEQ ID NO: 2 (or equivalent position of other albumins or variants or fragments thereof). Such alterations may comprise 574D+573P (e.g. SEQ ID NO: 121), 574F+573P (e.g. SEQ ID NO: 122), 574G+573P (e.g. SEQ ID NO: 123), 574H+573P (e.g. SEQ ID NO: 124), 574N+573P (e.g. SEQ ID NO: 125) or 574S+573P (e.g. SEQ ID NO: 126). It is preferred that the variant does not consist of SEQ ID NO: 2 with only alterations K573P+K574N+A577T+A578R+S579C+Q580K+A581D+G584A.

A variant albumin may comprise alterations at positions corresponding to positions 573+580 of SEQ ID NO: 2 (or equivalent position of other albumins or variants or fragments thereof). Such alterations may comprise 580K+573P (e.g. SEQ ID NO: 128) or 580R+573P (e.g. SEQ ID NO: 129). However, it is preferred that the variant does not consist of SEQ ID NO: 2 with only alterations K573P+A577E+A578S+Q580K+A582T.

A variant albumin may comprise alterations at positions corresponding to positions 574+580 of SEQ ID NO: 2 (or equivalent position of other albumins or variants or fragments thereof).

A variant albumin may comprise alterations at positions corresponding to positions 492+550+573 of SEQ ID NO: 2 (or equivalent position of other albumins or variants or fragments thereof). Such alterations may comprise 492G+550K+573P (e.g. SEQ ID NO: 254) or 492D+550K+573P (e.g. SEQ ID NO: 253).

A variant albumin may comprise alterations at positions corresponding to positions 492+550+574 of SEQ ID NO: 2 (or equivalent position of other albumins or variants or fragments thereof). Such alterations may comprise 492G+550K+574H (e.g. SEQ ID NO: 255).

A variant albumin may comprise alterations at positions corresponding to positions 492+550+580 of SEQ ID NO: 2 (or equivalent position of other albumins or variants or fragments thereof). Such alterations may comprise 492D+550K+580K (e.g. SEQ ID NO: 258) or 492G+550K+580K (e.g. SEQ ID NO: 259).

A variant albumin may comprise alterations at positions corresponding to positions 492+573+574 of SEQ ID NO: 2 (or equivalent position of other albumins or variants or fragments thereof). Such alterations may comprise 492D+573P+574H (e.g. SEQ ID NO: 233).

A variant albumin may comprise alterations at positions corresponding to positions 492+573+580 of SEQ ID NO: 2 (or equivalent position of other albumins or variants or fragments thereof). Such alterations may comprise 492D+573P+580K (e.g. SEQ ID NO: 234) or 492G+573P+580K (e.g. SEQ ID NO: 242).

A variant albumin may comprise alterations at positions corresponding to positions 492+574+580 of SEQ ID NO: 2 (or equivalent position of other albumins or variants or fragments thereof). Such alterations may comprise 492D+574H+580K (SEQ ID NO: 262) or 492G+574H+580K (e.g. SEQ ID NO: 263).

A variant albumin may comprise alterations at positions corresponding to positions 50+573+574 of SEQ ID NO: 2 (or equivalent position of other albumins or variants or fragments thereof). Such alterations may comprise 550K+574H+573P (e.g. SEQ ID NO: 131), 550L+573P+574H (e.g. SEQ ID NO: 246) or 550M+573P+574H (e.g. SEQ ID NO: 250).

A variant albumin may comprise alterations at positions corresponding to positions 550+573+580 of SEQ ID NO: 2 (or equivalent position of other albumins or variants or fragments thereof). Such alterations may comprise 550L+573P+580K (e.g. SEQ ID NO: 248) or 550M+573P+580K (e.g. SEQ ID NO: 252).

A variant albumin may comprise alterations at positions corresponding to positions 550+574+580 of SEQ ID NO: 2 (or equivalent position of other albumins or variants or fragments thereof).

A variant albumin may comprise alterations at positions corresponding to positions 573+574+580 of SEQ ID NO: 2 (or equivalent position of other albumins or variants or fragments thereof). Such alterations may comprise 574H+580K+573P (e.g. SEQ ID NO: 135).

A variant albumin may comprise alterations at positions corresponding to positions 492+550+573+574 of SEQ ID NO: 2 (or equivalent position of other albumins or variants or fragments thereof). Such alterations may comprise 492G+550K+573P+574H (e.g. SEQ ID NO: 257) or 492D+550K+573P+574H (e.g. SEQ ID NO: 256).

A variant albumin may comprise alterations at positions corresponding to positions 492+550+573+580 of SEQ ID NO: 2 (or equivalent position of other albumins or variants or fragments thereof). Such alterations may comprise 492D+550K+573P+580K (e.g. SEQ ID NO: 260) or 492G+550K+573P+580K (e.g. SEQ ID NO: 261).

A variant albumin may comprise alterations at positions corresponding to positions 492+550+574+580 of SEQ ID NO: 2 (or equivalent position of other albumins or variants or fragments thereof).

A variant albumin may comprise alterations at positions corresponding to positions 492+573+574+580 of SEQ ID NO: 2 (or equivalent position of other albumins or variants or fragments thereof). Such alterations may comprise 492D+573P+574H+580K (e.g. SEQ ID NO: 114) or 492G+573P+574H+580K (e.g. SEQ ID NO: 115), 492F+573P+574G+580K (e.g. SEQ ID NO: 238), 492G+573P+574G+580K (e.g. SEQ ID NO: 234), 492D+573P+574G+580K (e.g. SEQ ID NO: 235), 492F+573P+574H+580R (e.g. SEQ ID NO: 239), 492D+573P+574H+580K (e.g. SEQ ID NO: 264), 492G+573P+574H+580R (e.g. SEQ ID NO: 244), 492D+573P+574H+580R (e.g. SEQ ID NO: 236) or 492F+573P+574H+580K (e.g. SEQ ID NO: 237).

A variant albumin may comprise alterations at positions corresponding to positions 550+573+574+580 of SEQ ID NO: 2 (or equivalent position of other albumins or variants or fragments thereof). Such alterations may comprise 550K+573P+574H+580K (e.g. SEQ ID NO: 265).

A variant albumin may comprise alterations at positions corresponding to positions 492+550+573+574+580 of SEQ ID NO: 2 (or equivalent position of other albumins or variants or fragments thereof). Such alterations may comprise 492D+550K+573P+574H+580K (e.g. SEQ ID NO: 266) or 492G+550K+573P+574H+580K (e.g. SEQ ID NO: 267). Such alterations may comprise 492D+550K+573P+574H (e.g. SEQ ID NO: 256).

Particularly preferred variants include:

a variant albumin with alterations at positions corresponding to positions 492 and 580 in SEQ ID NO: 2, such as (i) E492G and Q580K, or (ii) E492D and Q580K (or equivalent positions of other albumins or variants or fragment thereof);

a variant albumin comprising alterations at positions corresponding to positions 492 and 574 in SEQ ID NO: 2, such as (i) E492G and K574H, (ii) E492D and K574H, (iii) E492D and K574K, or (iv) E492G and K574K (or equivalent positions of other albumins or variants or fragment thereof);

a variant albumin comprising alterations at positions corresponding to positions 492 and 550 in SEQ ID NO: 2, such as (i) E492G and D550K, or (ii) E492D and D550K (or equivalent positions of other albumins or variants or fragment thereof);

a variant albumin comprising alterations at positions corresponding to positions 550 and 573 in SEQ ID NO: 2, such as (i) D550K and K573P, (ii) D550L and K573P or (iii) D550M and K573P (or equivalent positions of other albumins or variants or fragment thereof);

a variant albumin comprising alterations at positions corresponding to positions 550 and 574 in SEQ ID NO: 2, such as (i) D550K and K574H, or (ii) D550L and K574H (or equivalent positions of other albumins or variants or fragment thereof);

a variant albumin comprising alterations at positions corresponding to positions 550 and 580 in SEQ ID NO: 2, such as (i) D550M and Q580K, (ii) D550L and Q580K or (iii) D550K and Q580K (or equivalent positions of other albumins or variants or fragment thereof);

a variant albumin with alterations (e.g. comprising alterations) at positions corresponding to positions 580 and 573 in SEQ ID NO: 2, such as Q580K and K573P (or equivalent positions of other albumins or variants or fragment thereof) and preferably one or more (several) other alterations such at a position selected from 492, 550 and 574. If there is a K at position 580 and a P at position 573 it is preferred that the polypeptide comprises an additional alteration at a position selected from the group consisting of 492, 550,and 574;

a variant albumin with alterations (e.g. comprising alterations) at positions corresponding to positions 492 and 573 in SEQ ID NO: 2, such as:

a variant albumin comprising alterations at positions corresponding to positions 492 and 573 in SEQ ID NO: 2, such as (i) E492D and K573P (or equivalent positions of other albumins or variants or fragment thereof) or (ii) E492G and K573P or (iii) E492G and K573A (or equivalent positions of other albumins or variants or fragment thereof), and preferably one or more (several) other alterations such at a position selected from 550, 574 and 580. If there is a G at position 492 and an A or P at position 573 it is preferred that the polypeptide comprises an additional alteration at a position selected from the group consisting of 550, 574 and 580 (or equivalent positions of other albumins or variants or fragment thereof);

a variant albumin comprising alterations at positions corresponding to positions 573 and 574 in SEQ ID NO: 2, such as K573P and K574H (or equivalent positions of other albumins or variants or fragment thereof, and preferably one or more (several) alterations such as at a position selected from 492, 550 and 580. If there is a P at position 573 and an N at position 574 it is preferred that the polypeptide comprises an additional alteration at a position selected from the group consisting of 492, 550, and 580 (or equivalent positions of other albumins or variants or fragment thereof);

a variant albumin comprising alterations at positions corresponding to positions 574 and 580 in SEQ ID NO: 2, such as 574H and 580K (or equivalent positions of other albumins or variants or fragment thereof, and preferably one or more (several) alterations such as at a position selected from 492, 550 and 573. If there is a N at position 574 and a K at position 580 it is preferred that the polypeptide comprises an additional alteration at a position selected from the group consisting of 492, 550, and 573 (or equivalent positions of other albumins or variants or fragment thereof);

a variant albumin comprising alterations at positions corresponding to positions 492, 550 and 573 in SEQ ID NO: 2, such as E492G, D550K and K573P e.g. SEQ ID NO: 254 or such as E492D, D550K and K573P e.g. SEQ ID NO: 253;

a variant albumin comprising alterations at positions corresponding to positions 550, 573 and 580 in SEQ ID NO: 2, such as D550K, K573P and Q580K e.g. SEQ ID NO: 133;

a variant albumin comprising alterations at positions corresponding to positions 550, 573 and 580 in SEQ ID NO: 2, such as D550L, K573P and Q580K e.g. SEQ ID NO:248 or such as D550M, K573P and Q580K e.g. SEQ ID NO:252;

a variant albumin comprising alterations at positions corresponding to positions 550, 573 and 574 in SEQ ID NO: 2, such as D550L, K573P and K574H e.g. SEQ ID NO:246;

a variant albumin comprising alterations at positions corresponding to positions 550, 573 and 574 in SEQ ID NO: 2, such as D550K, K573P and K574H e.g. SEQ ID NO: 131;

a variant albumin comprising alterations at positions corresponding to positions 492, 573 and 580 in SEQ ID NO: 2, such as E492G, K573P and Q580K e.g. SEQ ID NO: 242;

a variant albumin comprising alterations at positions corresponding to positions 492, 573 and 580 in SEQ ID NO: 2, such as E492D, K573P and Q580K e.g. SEQ ID NO: 234;

a variant albumin comprising alterations at positions corresponding to positions 492, 550, 573 and 574 in SEQ ID NO: 2, such as E492D, D550K, K573P and K574H e.g. SEQ ID NO: 256;

a variant albumin comprising alterations at positions corresponding to positions 492, 550, 573 and 574 in SEQ ID NO: 2, such as E492G, D550K, K573P and K574H e.g. SEQ ID NO: 257;

a variant albumin comprising alterations at positions corresponding to positions 573, 574 and 580 in SEQ ID NO: 2, such as K573P, K574H and Q580K e.g. SEQ ID NO: 135;

a variant albumin with alterations (e.g. comprising alterations) at positions corresponding to positions 492, 573, 574 and 580 in SEQ ID NO: 2, such as E492D, K573P, K574H and Q580K (or equivalent positions of other albumins or variants or fragment thereof), e.g. SEQ ID NO: 114;

a variant albumin with alterations (e.g. comprising alterations) at positions corresponding to positions 492, 573, 574 and 580 in SEQ ID NO: 2, such as E492G, K573P, K574H and Q580K (or equivalent positions of other albumins or variants or fragment thereof), e.g. SEQ ID NO: 115.

It is preferred that the variant albumin does not consist of SEQ ID NO: 2 with only the following alterations: K573P+K574N+A577T+A578R+S579C+Q580K+A581D+G584A; K573P+A577E+A578S+Q580K+A582T; E492G+K573A; E492G+N503K+K573A; E492G+N503H+K573A; E492G+K573P; E492G+N503H+K573P. Such variant albumins are disclosed in WO2011/051489.

It is preferred that the variant albumin does not consist of SEQ ID NO: 2 with amino acids 573 to 585 replaced with (a) KKLVAASQAALGL, (b) PKFVAASQAALA, (c) PNLVTRCKDALA, (d) PKLVESSKATLG or (e) PKLVASTQAALA.

It is preferred that the variant albumin, a fragment thereof or fusion polypeptide comprising the variant albumin or fragment thereof has altered binding affinity to FcRn and/or an altered plasma half-life compared with the corresponding parent or reference albumin, fragment thereof, or fusion polypeptide comprising the variant albumin or fragment thereof and/or an altered binding affinity to FcRn.

In a particularly preferred embodiment the parent or reference albumin is HSA (SEQ ID NO: 2) and the variant albumin, a fragment thereof or fusion polypeptide comprising the variant albumin or fragment thereof has altered binding affinity to FcRn and/or an altered plasma half-life compared with the HSA, the corresponding fragment or fusion polypeptide comprising HSA or fragment thereof and/or an altered binding affinity to FcRn.

The correlation between binding of albumin to its receptor and plasma half-life has been realized by the present inventors based on the natural occurring allele of HSA D494N. The inventors have previously analyzed this allele and found that it has a lower affinity to its receptor FcRn than the affinity of WT HSA to FcRn.

Further, it has been disclosed that a transgenic mouse having the natural mouse FcRn replaced with human FcRn has a higher serum albumin level than normal mouse (J Exp Med. (2003) 197(3):315-22). It has previously been discovered that human FcRn has a higher affinity to mouse serum albumin than mouse FcRn has to mouse serum albumin and, therefore, the observed increase in serum albumin in the transgenic mice corresponds with a higher affinity between serum albumin and its receptor, confirming the correlation between albumin binding to FcRn and plasma half-life. In addition, variants of albumin that have little or no binding to FcRn have been shown to have reduced half-life in a mouse model, Kenanova et al (2009) *J. Nucl. Med.;* 50 (Supplement 2):1582).

One way to determine whether the affinity of a variant albumin to FcRn is higher or lower than the parent or reference albumin is to use the Surface Plasmon Resonance assay (SPR) as described below. The skilled person will understand that other methods might be useful to determine whether the affinity of a variant albumin to FcRn is higher or lower than the affinity of the parent or reference albumin to FcRn, e.g., determination and comparison of the binding constants KD. The binding affinity (KD) between a first molecule (e.g. ligand) and a second molecule (e.g. receptor) is a function of the kinetic constants for association (on rate, $k_a$) and dissociation (off-rate, $k_d$) according to $KD=k_d/k_a$. Thus, according to the invention variant albumins having a KD that is lower than the KD for natural HSA is considered to have a higher plasma half-life than HSA and variant albumins having a KD that is higher than the KD for natural HSA is considered to have a lower plasma half-life than HSA.

In an embodiment of the invention, the variants of albumin or fragments thereof, or fusion polypeptides comprising variant albumin or a fragment thereof according to the invention have a plasma half-life that is longer than the plasma half-life of the parent or reference albumin fragment thereof or fusion polypeptide comprising the parent or reference albumin or a fragment thereof and/or an stronger binding affinity to FcRn.

In a further embodiment the variants of albumin or fragments thereof, or fusion polypeptides comprising variant albumin or fragments thereof according to the invention have a plasma half-life that is shorter than the plasma half-life of the parent or reference albumin fragment thereof or fusion polypeptide comprising the parent or reference albumin or a fragment thereof and/or an weaker binding affinity to FcRn.

In addition to alterations at two or more positions selected from 492, 550, 573, 574 and/or 580 (or equivalent position of other albumins or variants or fragments thereof) the variant albumin or fragments thereof, or fusion polypeptides comprising variant albumin or fragments thereof according to the invention may contain additional substitutions, deletions or insertions in other positions of the molecules. Such additional substitutions, deletions or insertions may be useful in order to alter other properties of the molecules such as but not limited to altered glycosylation; introduction of reactive groups of the surface such a thiol groups, removing/generating a carbamoylation site; etc.

Residues that might be altered in order to provide reactive residues on the surface and which advantageously could be applied to the invention has been disclosed in WO2010/092135 (incorporated herein by reference). Particular preferred residues include the positions corresponding to positions in SEQ ID NO: 2.

As examples of alterations that can be made in SEQ ID NO: 2 or in corresponding positions in other albumins in order to provide a reactive thiol group on the surface includes alterations corresponding to following alterations in SEQ ID NO: 2: L585C, D1C, A2C, D562C, A364C, A504C, E505C, T79C, E86C, D129C, D549C, A581C, D121C, E82C, S270C, A578C, L595LC, D1DC, A2AC, D562DC, A364AC, A504AC, E505EC, T79TC, E86EC, D129DC, D549DC, A581AC, A581AC, D121DC, E82EC, S270SC, A579AC, C360*, C316*, C75*, C168*, C558*, C361*, C91*, C124*, C169* and C567*. Alternatively a cysteine residue may be added to the N or C terminal of albumin. The term 'reactive thiol' means and/or includes a thiol group provided by a Cys which is not disulphide bonded to a Cysteine and/or which is sterically available for binding to a partner such as a conjugation partner.

Fusion Polypeptides

A second aspect of the invention relates to fusion polypeptides. Therefore, the variants of albumin or fragments thereof according to the invention may be fused with a non-albumin polypeptide fusion partner. The fusion partner may in principle be any polypeptide but generally it is preferred that the fusion partner is a polypeptide having therapeutic, prophylactic (including vaccine), diagnostic, imaging or other beneficial properties. Such properties may be referred to as 'pharmaceutically beneficial properties'. Fusion polypeptides comprising albumin or fragments thereof are known in the art. It has been found that such fusion polypeptides comprising albumin or a fragment thereof and a fusion partner polypeptide have a longer plasma half-life compared to the unfused fusion partner polypeptide alone. According to the invention it is possible to alter the plasma half-life of the fusion polypeptides according to the invention compared to the corresponding fusion polypeptides of the prior art. 'Alter' includes both increasing the plasma half-life or decreasing the plasma half-life. Increasing the plasma half-life is preferred. The invention allows tailoring of half-life to a term desired.

One or more (several) therapeutic, prophylactic (including vaccine), diagnostic, imaging or other beneficial polypeptides may be fused to the N-terminus, the C-terminus of albumin, inserted into a loop in the albumin structure or any combination thereof. It may or it may not comprise linker sequences separating the various components of the fusion polypeptide.

Teachings relating to fusions of albumin or a fragment thereof are known in the art and the skilled person will appreciate that such teachings can also be applied to the invention. WO 2001/79271A (particularly page 9 and/or Table 1), WO 2003/59934 (particularly Table 1), WO03/060071 (particularly Table 1) and WO01/079480 (particularly Table 1) (each incorporated herein by reference in their entirety) also contain examples of therapeutic, prophylactic (including vaccine), diagnostic, imaging or other beneficial polypeptides that may be fused to albumin or fragments thereof, and these examples apply also to the invention.

Further preferences for the second aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Polynucleotides

A third aspect of the invention relates to isolated polynucleotides that encode any of the variants or fusion polypeptides of the invention. The polynucleotide may be an isolated polynucleotide. The polynucleotide may be comprised in a vector (such as a plasmid) and/or in a host cell.

Further preferences for the third aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Nucleic Acid Constructs

A fourth aspect of the invention relates to nucleic acid constructs comprising a polynucleotide encoding a variant or fusion polypeptide of the invention operably linked to one or more (several) control sequences that direct the expression of the coding sequence in a suitable host cell under conditions compatible with the control sequences.

A polynucleotide may be manipulated in a variety of ways to provide for expression of a variant. Manipulation of the polynucleotide prior to its insertion into a vector may be desirable or necessary depending on the expression vector. The techniques for modifying polynucleotides utilizing recombinant DNA methods are well known in the art.

The control sequence may be a promoter sequence, which is recognized by a host cell for expression of the polynucleotide. The promoter sequence contains transcriptional control sequences that mediate the expression of the variant. The promoter may be any nucleic acid sequence that shows transcriptional activity in the host cell including mutant, truncated, and hybrid promoters, and may be obtained from genes encoding extracellular or intracellular polypeptides either homologous or heterologous to the host cell.

In a yeast host, useful promoters are obtained from the genes for *Saccharomyces cerevisiae* enolase (ENO-1), *Saccharomyces cerevisiae* protease A (PRA1), *Saccharomyces cerevisiae* protease B (PRB1), *Saccharomyces cerevisiae* translation elongation factor (TEF1), *Saccharomyces cerevisiae* translation elongation factor (TEF2), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, *Yeast* 8: 423-488.

The skilled person knows useful promoters for use in rice and mammalian cells, such as CHO or HEK. In a rice host, useful promoters are obtained from cauliflower mosaic virus 35S RNA gene (CaMV35S), maize alcohol dehydrogenase (Adh1) and alpha Amy3.

In a mammalian host cell, such as CHO or HEK, useful promoters are obtained from Cytomegalovirus (CMV) and CAG hybrid promoter (hybrid of CMV early enhancer element and chicken beta-actin promoter), Simian vacuolating virus 40 (SV40).

The control sequence may also be a suitable transcription terminator sequence, which is recognized by a host cell to terminate transcription. The terminator sequence is operably linked to the 3'-terminus of the polynucleotide encoding the variant. Any terminator that is functional in the host cell may be used.

Preferred terminators for yeast host cells are obtained from the genes for *Saccharomyces cerevisiae* enolase, *Saccharomyces cerevisiae* cytochrome C (CYC1), *Saccharomyces cerevisiae* alcohol dehydrogenase (ADH1) and *Saccharomyces cerevisiae* glyceraldehyde-3-phosphate dehydrogenase. Other useful terminators for yeast host cells are described by Romanos et al., 1992, supra. The skilled person knows useful terminators for use in rice and mammalian cells, such as CHO or HEK. For example, in a rice host, preferred terminators are obtained from *Agrobacterium tumefaciens* nopaline synthase (Nos) and cauliflower mosaic virus 35S RNA gene (CaMV35S).

The control sequence may also be a suitable leader sequence, a nontranslated region of an mRNA that is important for translation by the host cell. The leader sequence is operably linked to the 5'-terminus of the polynucleotide encoding the variant. Any leader sequence that is functional in the host cell may be used.

Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3'-terminus of the variant-encoding sequence and, when transcribed, is recognized by the host cell as a signal to add polyadenosine residues to transcribed mRNA. Any polyadenylation sequence that is functional in the host cell may be used.

Useful polyadenylation sequences for yeast host cells are described by Guo and Sherman, 1995, *Mol. Cellular Biol.* 15: 5983-5990.

The control sequence may also be a signal peptide coding region that encodes a signal peptide linked to the N-terminus of a variant and directs the variant into the cell's secretory pathway. The 5'-end of the coding sequence of the polynucleotide may inherently contain a signal peptide coding region naturally linked in translation reading frame with the segment of the coding region that encodes the variant. Alternatively, the 5'-end of the coding sequence may contain a signal peptide coding region that is foreign to the coding sequence. The foreign signal peptide coding region may be required where the coding sequence does not naturally contain a signal peptide coding region. Alternatively, the foreign signal peptide coding region may simply replace the natural signal peptide coding region in order to enhance secretion of the variant. However, any signal peptide coding region that directs the expressed variant into the secretory pathway of a host cell may be used.

Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra. The skilled person knows useful signal peptides for use in rice and mammalian cells, such as CHO or HEK.

Where both signal peptide and propeptide regions are present at the N-terminus of a variant, the propeptide region is positioned next to the N-terminus of the variant and the signal peptide region is positioned next to the N-terminus of the propeptide region.

Further preferences for the fourth aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Preparation of Variants

A fifth aspect of the invention relates to a method for preparing or obtaining a variant albumin or fragment thereof, or fusion polypeptides comprising the variant albumin or fragments thereof, or associates of variant albumin or fragment thereof comprising:

(a) introducing into a parent albumin or fragments thereof, or fusion polypeptides comprising the parent albumin or fragments thereof an alteration at two or more positions selected from 492, 550, 573, 574 and 580, preferably as described for the first aspect of the invention; and (b) recovering the variant albumin or fragment thereof, or fusion polypeptides comprising the variant albumin or fragment thereof.

Preferred alterations are as described in relation to the first aspect of the invention. The resultant variant albumin or fragment thereof may have altered FcRn-binding affinity compared to the FcRn-binding affinity of a reference such as a parent albumin or fragment which does not comprise the alterations. More preferably, the resultant variant albumin or fragment thereof has a stronger FcRn-binding affinity.

The invention includes a method for preparing a polypeptide which is a variant of albumin, fragment thereof or fusion polypeptide comprising said variant albumin or fragment thereof having a binding affinity to FcRn which is altered compared to the binding affinity of a reference albumin, fragment or fusion thereof to FcRn, comprising:

(a) providing a nucleic acid encoding a parent albumin such as an albumin having at least 60% sequence identity to SEQ ID NO: 2;

(b) modifying the sequence of step (a), to encode a polypeptide which is a variant albumin, fragment thereof or fusion polypeptide comprising said variant albumin or fragment thereof comprising alterations at two or more positions corresponding to positions selected from selected among two or more of the group consisting of positions 492, 550, 573, 574 and 580 in SEQ ID NO: 2;

(c) optionally, introducing the modified sequence of step (b) in a suitable host cell;

(d) optionally, growing the cells in a suitable growth medium under condition leading to expression of the polypeptide; and (e) optionally, recovering the polypeptide from the growth medium;

wherein the polypeptide has an altered binding affinity to FcRn and/or an altered plasma half-life compared with the half-life of a parent albumin, reference albumin, fragment thereof or fusion polypeptide comprising said parent albumin, reference albumin or fragment or fusion thereof.

It is preferred that the parent albumin and/or the variant albumin comprises or consists of:

(a) a polypeptide having at least 60% sequence identity to the mature polypeptide of SEQ ID NO: 2;

(b) a polypeptide encoded by a polynucleotide that hybridizes under low stringency conditions with (i) the mature polypeptide coding sequence of SEQ ID NO: 1, or (ii) the full-length complement of (i);

(c) a polypeptide encoded by a polynucleotide having at least 60% identity to the polypeptide coding sequence of SEQ ID NO: 1; and/or (d) a fragment of the mature polypeptide of SEQ ID NO: 2.

The variants can be prepared by those skilled persons using any mutagenesis procedure known in the art, such as site-directed mutagenesis, synthetic gene construction, semi-synthetic gene construction, random mutagenesis, shuffling, etc.

Site-directed mutagenesis is a technique in which one or more (several) mutations (alterations) are created at one or more (several) defined sites in a polynucleotide encoding the parent.

Site-directed mutagenesis can be accomplished in vitro by PCR involving the use of oligonucleotide primers containing the desired mutation. Site-directed mutagenesis can also be performed in vitro by cassette mutagenesis involving the cleavage by a restriction enzyme at a site in the plasmid comprising a polynucleotide encoding the parent and subsequent ligation of an oligonucleotide containing the mutation in the polynucleotide. Usually the restriction enzyme that digests at the plasmid and the oligonucleotide is the same, permitting ligation of the plasmid and insert to one another. See, e.g., Scherer and Davis, 1979, *Proc. Natl. Acad. Sci. USA* 76: 4949-4955; and Barton et al., 1990, *Nucleic Acids Res.* 18: 7349-4966.

Site-directed mutagenesis can also be accomplished in vivo by methods known in the art. See, e.g., U.S. Patent Application Publication NO: 2004/0171154; Storici et al., 2001, *Nature Biotechnol.* 19: 773-776; Kren et al., 1998, *Nat. Med.* 4: 285-290; and Calissano and Macino, 1996, *Fungal Genet. Newslett.* 43: 15-16.

Any site-directed mutagenesis procedure can be used in the invention. There are many commercial kits available that can be used to prepare variants.

Synthetic gene construction entails in vitro synthesis of a designed polynucleotide molecule to encode a polypeptide of interest. Gene synthesis can be performed utilizing a number of techniques, such as the multiplex microchip-based technology described by Tian et al. (2004, *Nature* 432: 1050-1054) and similar technologies wherein oligonucleotides are synthesized and assembled upon photo-programmable microfluidic chips.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204) and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

Semi-synthetic gene construction is accomplished by combining aspects of synthetic gene construction, and/or site-directed mutagenesis, and/or random mutagenesis, and/or shuffling. Semi-synthetic construction is typified by a process utilizing polynucleotide fragments that are synthesized, in combination with PCR techniques. Defined regions of genes may thus be synthesized de novo, while other regions may be amplified using site-specific mutagenic primers, while yet other regions may be subjected to error-prone PCR or non-error prone PCR amplification. Polynucleotide sub sequences may then be shuffled.

Further preferences for the fifth aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Methods of Production

A sixth aspect of the invention relates to methods of preparation of a variant according to the invention. The variants of the invention can be prepared using techniques well known to the skilled person. One convenient way is by cloning nucleic acid encoding the parent albumin or a fragment thereof or fusion polypeptide comprising albumin or a fragment thereof, modifying said nucleic acid to introduce the desired substitution(s) at two or more positions corresponding to positions selected from 492, 550, 573, 574 and 580 of the mature polypeptide of SEQ ID NO: 2 (or equivalent positions in other albumins or fragments thereof), preferably as described for the first or fifth aspects of the invention, preparing a suitable genetic construct where the modified nucleic acid is placed in operative connection with suitable regulatory genetic elements, such as promoter, terminator, activation sites, ribosome binding sites etc., introducing the genetic construct into a suitable host organism, culturing the transformed host organism under conditions leading to expression of the variant and recovering the variant. All these techniques are known in the art and it is within the skills of the average practitioner to design a suitable method for preparing a particular variant according to the invention.

The variant polypeptide of the invention may also be connected to a signal sequence in order to have the variant polypeptide secreted into the growth medium during culturing of the transformed host organism. It is generally advantageous to have the variant polypeptide secreted into the growth medium in order to ease recovery and purification.

Techniques for preparing variant polypeptides have also been disclosed in WO 2009019314 (included by reference) and these techniques may also be applied to the invention.

Albumins have been successfully expressed as recombinant proteins in a range of hosts including fungi (including but not limited to *Aspergillus* (WO06066595), *Kluyveromyces* (Fleer 1991, *Bio/technology* 9, 968-975), *Pichia* (Kobayashi 1998 *Therapeutic Apheresis* 2, 257-262) and *Saccharomyces* (Sleep 1990, *Bio/technology* 8, 42-46)), bacteria (Pandjaitab 2000, *J. Allergy Clin. Immunol.* 105, 279-285)), animals (Barash 1993, *Transgenic Research* 2, 266-276) and plants (including but not limited to potato and tobacco (Sijmons 1990, *Bio/technology* 8, 217 and Farran 2002, *Transgenic Research* 11, 337-346) and rice e.g. *Oryza sativa*) and mammalian cells such as CHO and HEK. The variant polypeptide of the invention is preferably produced recombinantly in a suitable host cell. In principle any host cell capable of producing a polypeptide in suitable amounts may be used and it is within the skills of the average practitioner to select a suitable host cell according to the invention. A preferred host organism is yeast, preferably selected among *Saccharomycacae*, more preferred *Saccharomyces cerevisiae*.

The variant polypeptides of the invention may be recovered and purified from the growth medium using a combination of known separation techniques such as filtration, centrifugation, chromatography, and affinity separation techniques etc. It is within the skills of the average practitioner to purify the variants of the invention using a particular combination of such known separation steps. As an example of purification techniques that may be applied to the variants of the invention can be mentioned the teaching of WO00/44772.

The variant polypeptides of the invention may be used for delivering a therapeutically beneficial compound (including prophylactically beneficial compound such as a vaccine) to an animal or a human individual in need thereof. Such therapeutically beneficial compounds include, but are not limited, to labels and readily detectable compounds for use in diagnostics, such as various imaging techniques; pharmaceutical active compounds such as drugs, or specifically binding moieties such as antibodies. The variants of the invention may even be connected to two or more different therapeutically beneficial compounds, e.g., an antibody and a drug, which gives the combined molecule the ability to bind specifically to a desired target and thereby provide a high concentration of the connected drug at that particular target.

Further preferences for the sixth aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Conjugates

A seventh aspect of the invention relates to conjugates (conjugations). Therefore, the variants of albumin or fragments thereof or fusion polypeptides according to the invention may be conjugated to a second molecule ('conjugation partner') using techniques known within the art. The conjugation partner may be a therapeutic, prophylactic (including vaccine), diagnostic, imaging or other beneficial moiety. Said conjugation partner may be a polypeptide or a non-polypeptide chemical. The conjugation partner may be a polypeptide, chemical (e.g. chemically synthesised drug) or a nucleic acid (e.g. DNA, RNA, siRNA).

Said second molecule may comprise a diagnostic or imaging moiety, and in this embodiment the conjugate may be useful as a diagnostic tool such as in imaging; or the second molecule may be a therapeutic or prophylactic (e.g. vaccine) compound and in this embodiment the conjugate may be used for therapeutic or prophylactic (e.g. vaccination) purposes where the conjugate will have the therapeutic or prophylactic properties of the therapeutic or prophylactic compound as well as the desirable plasma half-life provided by the albumin part of the conjugate. Conjugates of albumin and a therapeutic molecule are known in the art and it has been verified that such conjugates have long plasma half-life compared with the non-conjugated, free therapeutic molecule as such. According to the invention it is possible to alter the binding affinity to FcRn and/or plasma half-life of the conjugate according to the invention compared to the corresponding conjugates of the prior art. 'Alter' includes both increasing the plasma half-life and decreasing the plasma half-life binding affinity to FcRn and/or increasing the binding affinity and decreasing the binding affinity to FcRn. Increasing the plasma half-life and/or binding affinity to FcRn is preferred. The conjugates may conveniently be linked via a free thiol group present on the surface of HSA (amino acid residue 34 of mature HSA) using well known chemistry.

In one particular preferred aspect the variant albumin or fragment thereof is conjugated to a beneficial therapeutic or prophylactic (including vaccine) compound and the conjugate is used for treatment of a condition in a patient in need thereof, which condition is responsive to the particular selected therapeutic compound. Techniques for conjugating such a therapeutically useful compound to the variant albumin or fragment thereof are known in the art. WO 2009/019314 (incorporated herein by reference in its entirety) discloses examples of techniques suitable for conjugating a therapeutically compound to a polypeptide which techniques can also be applied to the invention. Further WO 2009/019314 discloses examples of compounds and moieties that may be conjugated to substituted transferrin and these examples may also be applied to the invention. The teaching of WO 2009/019314 is included herein by reference.

HSA contains in its natural form one free thiol group (at Cys34) that conveniently may be used for conjugation. As a particular embodiment within this aspect the variant albumin or fragment thereof may comprise further modifications provided to generate additional free thiol groups on the surface. This has the benefit that the payload of the variant albumin or fragment thereof is increased so that more than one molecule of the therapeutic (e.g. prophylactic) compound can be conjugated to each molecule of variant albumin or fragment thereof, or two or more (several) different therapeutic compounds may be conjugated to each molecule of variant albumin or fragment thereof, e.g., a compound having targeting properties such as an antibody specific for example a tumour; and a cytotoxic drug conjugated to the variant albumin or fragment thereof thereby creating a highly specific drug against a tumour. Teaching of particular residues that may be modified to provide for further free thiol groups on the surface can be found in co-pending patent application WO 2010/092135, which is incorporated by reference.

The conjugation partner may alternatively be conjugated to a fusion polypeptide (described herein), resulting in a molecule comprising a fusion partner fused to the albumin as well as a conjugation partner conjugated to the same albumin or even to the fusion partner.

Further preferences for the seventh aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Associates

An eighth aspect of the invention relates to associates. Therefore, the variants of albumin or fragments thereof or fusion polypeptides may further be used in form of "associates". In this connection the term "associate" is intended to mean a compound comprising a variant of albumin or a fragment thereof and another compound bound or associated to the variant albumin or fragment thereof by non-covalent binding. As an example of such an associate can be mentioned an associate consisting of variant albumin and a lipid associated to albumin by a hydrophobic interaction. Such associates are known in the art and they may be prepared using well known techniques. As an example of a preferred associate according to the invention can be mentioned, an associate comprising variant albumin and a taxane, a taxol or taxol derivative (e.g. paclitaxel). Further examples of associates comprise a therapeutic, prophylactic (including vaccine), diagnostic, imaging or other beneficial moiety.

The half-life of an albumin associate according to the invention may be longer or shorter than the half-life of the 'other compound' alone. The half-life of an albumin associate according to the invention may be longer or shorter than the half-life of the analogous/equivalent albumin associate comprising or consisting of a reference albumin such as native HSA (instead of an albumin variant or derivative according to the invention) and the 'other compound'. Likewise, the binding affinity to FcRn of an albumin associate according to the invention may be stronger or weaker than the binding affinity to FcRn of the analogous/equivalent albumin associate comprising or consisting of a reference albumin such as native HSA (instead of an albumin variant or derivative according to the invention) and the 'other compound'. Methods for the preparation of associates are well-known to the skilled person, for example, formulation (by association) of HSA with Lipo-compounds is described in Hussain, R. and Siligardi, G. (2006) International Journal of Peptide Research and Therapeutics, Vol. 12, NO: 3, pp. 311-315.

Further preferences for the eighth aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Compositions

A ninth aspect of the invention relates to compositions. Therefore the invention is also directed to the use of a variant of albumin or a fragment thereof or fusion polypeptides comprising variant albumin or fragments thereof, or a conjugate comprising a variant of albumin or a fragment thereof, or an associate comprising a variant of albumin or a fragment thereof for the manufacture of a pharmaceutical composition, wherein the variant of albumin or a fragment thereof or fusion polypeptides comprising variant albumin or fragments thereof, or a conjugate comprising a variant of albumin or a fragment thereof, or an associate comprising a variant of albumin or a fragment thereof has an altered binding affinity to FcRn and/or an altered plasma half-life compared with HSA or the corresponding fragment thereof or fusion polypeptide comprising HSA or fragment thereof or conjugate comprising HSA.

In this connection the corresponding fragment of HSA is intended to mean a fragment of HSA that aligns with and has same number of amino acids as the fragment of the variant albumin with which it is compared. Similarly the corresponding fusion polypeptide comprising HSA or conjugate comprising HSA is intended to mean molecules having same size and amino acid sequence as the fusion polypeptide of conjugate comprising variant albumin, with which it is compared.

The composition may comprise a pharmaceutically acceptable carrier or excipient such as water, polysorbate 80 or those specified in the US Pharmacopoeia for human albumin.

Further preferences for the ninth aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Nanoparticles

A tenth aspect of the invention relates to a nanoparticle comprising a variant, fusion, conjugate, associate, nanoparticle, composition or polynucleotide as disclosed herein.

Techniques for incorporation of a molecule into nano- or microparticles are known in the art. Preferred methods for preparing nano- or microparticles that may be applied to the albumin, variant, fragment, fusion, conjugate or associate thereof according to the invention is disclosed in WO 2004/071536 or WO2008/007146 or Oner & Groves (Pharmaceutical Research, Vol 10(9), 1993, pages 1387 to 1388) which are incorporated herein by reference. Preferably the average diameter of a nano-particle is from 5 to 1000 nm, more preferably 5, 10, 20, 30, 40, 50, 80, 100, 130, 150, 200, 300, 400, 500, 600, 700, 800, 900, or 999 to 5, 10, 20, 30, 40, 50, 80, 100, 130, 150, 200, 300, 400, 500, 600, 700, 800, 900, or 1000 nm. An advantage of a microparticle less than 200 nm diameter, and more particularly less than 130 nm, is that is amenable to sterilisation by filtration through a 0.2 μm (micron) filter. Preferably, the average diameter of a microparticle is from 1000 nm (1 μm (micron)) to 100 μm (micron), more preferably from 1, 2, 5, 10, 20, 30, 40, 50, 60, 70, 80, 90, 100 to 1, 2, 5, 10, 20, 30, 40, 50, 60, 70, 80, 90, 100 μm (micron).

Further preferences for the tenth aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Uses

An eleventh aspect of the invention relates to use of a variant albumin, fragment, fusion or conjugate thereof or nanoparticle or associate thereof. Use may be, for example, in a method of treatment, prophylaxis, diagnosis or imaging. The variant albumin or fragments thereof or fusion polypeptides comprising variant albumin or fragments thereof according to the invention have the benefit that their binding affinity to FcRn and/or plasma half-life is altered compared to the parent or reference albumin or fragments thereof or fusion polypeptides comprising parent or reference albumin or fragments thereof. This has the advantage that the binding affinity to FcRn and/or plasma half-life of conjugates comprising variant albumin or a fragment thereof or fusion polypeptide comprising variant albumin or a fragment thereof, or an associate comprising variant albumin or a fragment thereof according to the invention can be selected in accordance with the particular therapeutic purpose.

In some situations, it would be advantageous to use an albumin, variant, fragment, fusion, conjugate or associate or composition thereof having a longer plasma half-life than the reference molecule or composition since this would have the benefit that the administration of the albumin, variant, fragment, fusion, conjugate or associate or composition thereof would be needed less frequently or at a reduced dose (and consequently with fewer side effects) compared to the situation where the reference molecule or composition was used. With respect to the use of a variant, fusion, conjugate, associate, nanoparticle, composition or polynucleotide the albumin moiety may comprise one more alterations as disclosed herein.

In other situations, it would be advantageous to use an albumin, variant, fragment, fusion, conjugate or associate or composition thereof having a shorter plasma half-life than the reference molecule or composition since this would have the benefit that the administration of the albumin, variant, fragment, fusion, conjugate or associate or composition thereof can be carried out at a higher dose compared to the situation where the reference molecule or composition was used with the benefit that the administered compound clears from the recipient more quickly than if the reference molecule or composition was used. With respect to the use of a variant, fusion, conjugate, associate, nanoparticle, composition or polynucleotide the albumin moiety may comprise one more alterations as disclosed herein.

For example for a conjugate, associate or fusion polypeptide used for imaging purposes in animals or human beings, where the imaging moiety has an very short half-life and a conjugate or a fusion polypeptide comprising HSA has a plasma half-life that is far longer than needed for the imaging purposes it would be advantageous to use a variant albumin or fragment thereof of the invention having a shorter plasma half-life than the parent or reference albumin or fragment thereof, to provide conjugates of fusion polypeptides having a plasma half-life that is sufficiently long for the imaging purpose but sufficiently short to be cleared form the body of the particular patient on which it is applied.

In another example for a conjugate, an associate or fusion polypeptide comprising a therapeutic compound effective to treat or alleviate a particular condition in a patient in need for such a treatment it would be advantageous to use the variant albumin or fragment thereof having a longer plasma half-life than the parent or reference albumin or fragment thereof, to provide associates or conjugates or fusion polypeptides having longer plasma half-lives which would have the benefit that the administration of the associate or conjugate or fusion polypeptide of the invention would be needed less frequently or at reduced dose with less side effects compared to the situation where the parent or reference albumin or associates thereof or fragment thereof was used. For example, the invention provides a method of treating a proliferative disease in an individual, comprising administering the individual an effective amount of an associate according to the invention in which the associate comprises a taxane, a taxol or taxol derivative (e.g. paclitaxel).

In a further aspect the invention relates to compositions comprising the variant albumin, associates thereof or fragment thereof, variant albumin fragment or associates thereof or fusion polypeptide comprising variant albumin or fragment thereof according to the invention. The compositions are preferably pharmaceutical compositions. The composition may be prepared using techniques known in the area such as disclosed in recognized handbooks within the pharmaceutical field. Since the albumin, variant, fragment, fusion, conjugate or associate thereof has a binding affinity to FcRn and/or plasma half-life which is modulated (i.e. stronger or weaker and/or longer or shorter) than that of a reference molecule, the composition also has a binding affinity to FcRn and/or modulated plasma half-life relative to an equivalent composition comprising the reference molecule in place of the albumin, variant, fragment, fusion, conjugate or associate thereof as described herein. The composition may be a vaccine. The polypeptide according to the invention may be an active pharmaceutical or an excipient. Optionally, the composition is provided in unit dosage form.

Preferably the albumin, variant, fragment, fusion, conjugate or associate thereof has a plasma half-life that is longer than the plasma half-life of the reference molecule e.g. the same composition except that the albumin component (e.g. albumin, variant, fragment, fusion, conjugate or associate) is wild-type albumin (e.g. HSA) or a variant, fragment, fusion, conjugate or associate.

In a particular embodiment the compositions comprise a variant albumin or a fragment thereof according to the invention and a compound comprising a pharmaceutically beneficial moiety and an albumin binding domain (ABD). According to the invention ABD means a site, moiety or domain capable of binding to circulating albumin in vivo and thereby conferring transport in the circulation of the ABD and any compound or moiety bound to said ABD. ABD's are known in the art and have been shown to bind very tight to albumin so a compound comprising an ABD bound to albumin will to a certain extent behave as a single molecule. The inventors have realized by using the variant albumin or fragment thereof according to the invention together with a compound comprising a pharmaceutically beneficial moiety and an ABD makes it possible to alter the binding affinity to FcRn and/or plasma half-life of the compound comprising a pharmaceutically beneficial moiety and an ABD compared to the situation where said compound were injected as such in a patient having need thereof or administered in a formulation comprising natural albumin or a fragment thereof.

The variant albumin or fragments thereof, conjugates comprising variant albumin or a fragment thereof or fusion polypeptide comprising variant albumin or a fragment thereof, or an associate comprising variant albumin or a fragment thereof according to the invention may also be incorporated into nano- or microparticles using techniques well known within the art. A preferred method for preparing nano- or microparticles that may be applied to the variant albumins or fragments thereof according to the invention is disclosed in WO 2004/071536 or WO2008/007146 or Oner & Groves (Pharmaceutical Research, Vol 10(9), 1993, pages 1387 to 1388) which are incorporated herein by reference.

Further preferences for the eleventh aspect of the invention include those of the first aspect of the invention and those provided below the twelfth aspect of the invention. The skilled person understands that any aspect of the invention may be combined with another aspect or aspects of the invention and/or with one or more (several) of the preferences for the aspects of the invention and/or other disclosures made herein.

Method for Altering the FcRn-Binding Affinity or Half-Life of a Molecule

A twelfth aspect of the invention provides a method for altering the FcRn-binding affinity or half-life of a molecule comprising:

(a) where the molecule is a polypeptide, fusing or conjugating the molecule to a polypeptide disclosed herein or to a conjugate disclosed herein; associating the molecule to a polypeptide disclosed herein or to a conjugate disclosed herein; incorporating the molecule in a nanoparticle disclosed herein or a composition disclosed herein;

(b) where the molecule is not a polypeptide, conjugating the molecule to a polypeptide disclosed herein or to a conjugate disclosed herein; associating the molecule to a polypeptide disclosed herein or to a conjugate a disclosed herein; incorporating the molecule in a nanoparticle disclosed herein or a composition disclosed herein.

Examples of 'molecule' include those useful in therapy, prophylaxis (including those used in vaccines either as an active pharmaceutical ingredient or as an excipient), imaging and diagnosis, such as those described herein.

Further preferences for the twelfth aspect of the invention include those of the first aspect of the invention and those provided below this twelfth aspect of the invention. The skilled person understands that any aspect of the invention may be combined with another aspect or aspects of the invention and/or with one or more (several) of the preferences for the aspects of the invention and/or other disclosures made herein.

Preferences for all aspects of the invention are provided below. The skilled person understands that any aspect of the invention may be combined with another aspect or aspects of the invention and/or with one or more (several) of the preferences for the aspects of the invention and/or other disclosures made herein.

The variant of albumin or a fragment thereof or fusion polypeptides comprising variant albumin or fragments thereof, fragment thereof, conjugate, nanoparticle, associate or composition may have a plasma half-life that is either longer or shorter, preferably longer, than the plasma half-life than a corresponding albumin or a fragment thereof or fusion polypeptides comprising albumin or fragments thereof, fragment thereof, conjugate, nanoparticle, associate or composition or a binding to FcRn that is stronger or weaker, preferably weaker. Preferably the variant of albumin or a fragment thereof or fusion polypeptides comprising variant albumin or fragments thereof, fragment thereof, conjugate, nanoparticle, associate or composition has a plasma half-life that is longer than the plasma half-life of HSA or the corresponding albumin or a fragment thereof or fusion polypeptides comprising albumin or fragments thereof, fragment thereof, conjugate, nanoparticle, associate or composition.

Alternatively, this may be expressed as the variant of albumin or a fragment thereof or fusion polypeptides comprising variant albumin or fragments thereof, fragment thereof, conjugate, nanoparticle, associate or composition having a KD to FcRn (e.g. shFcRn) that is lower than the corresponding KD for HSA to FcRn or the corresponding fragment thereof or fusion polypeptide comprising HSA or fragment thereof. Preferably, the KD for the variant of albumin or a fragment thereof or fusion polypeptides comprising variant albumin or fragments thereof, fragment thereof, conjugate, nanoparticle, associate or composition is less than 0.9× KD for HSA to FcRn, more preferred less than 0.5× KD for HSA to FcRn, more preferred less than 0.1× KD for HSA to FcRn, even more preferred less than 0.05× KD for HSA to FcRn, even more preferred less than 0.02× KD for HSA to FcRn and most preferred less than 0.01× KD for HSA to FcRn (where X means 'multiplied by'). The KD of the variant of albumin or a fragment thereof or fusion polypeptides comprising variant albumin or fragments thereof, fragment thereof, conjugate, nanoparticle, associate or composition may be between the KD of WT albumin (e.g. SEQ ID No. 2) for FcRn and the KD of HSA K573P (SEQ ID No. 3) for FcRn. Such KDs represent binding affinities that are higher than the binding affinity between HSA and FcRn. A higher binding affinity indicates a longer half-life, for example plasma half-life.

Alternatively, the variant of albumin or a fragment thereof or fusion polypeptides comprising variant albumin or fragments thereof, fragment thereof, conjugate, nanoparticle, associate or composition has a plasma half-life that is shorter than the plasma half-life of HSA or the corresponding fragment thereof or fusion polypeptide comprising HSA or fragment thereof.

This may be expressed as the variant of albumin or a fragment thereof or fusion polypeptides comprising variant albumin or fragments thereof, fragment thereof, conjugate, nanoparticle, associate or composition having a KD to FcRn that is higher than the corresponding KD for HSA to FcRn or the corresponding of albumin or a fragment thereof or fusion polypeptides comprising albumin or fragments thereof, fragment thereof, conjugate, nanoparticle, associate or composition. Preferably, the KD for the variant of albumin or a fragment thereof or fusion polypeptides comprising variant albumin or fragments thereof, fragment thereof, or a conjugate comprising a variant of albumin or a fragment thereof is more than 2× KD for HSA to FcRn, more preferred more than 5× KD for HSA to FcRn, more preferred more than 10× KD for HSA to FcRn, even more preferred more than 25× KD for HSA to FcRn, most preferred more than 50× KD, more than 60×, more than 70× KD, more than 80×, more than 90× or more than 100× KD for HSA to FcRn. The variant of albumin or a fragment thereof or fusion polypeptides comprising variant albumin or fragments thereof, fragment thereof, conjugate, nanoparticle, associate or composition may be a null binder to FcRn.

The variant of albumin or a fragment thereof or fusion polypeptides comprising variant albumin or fragments thereof, fragment thereof, or a conjugate or nanoparticle or associate or composition comprising a variant of albumin or a fragment thereof is preferably the variant of albumin or a fragment thereof or fusion polypeptides comprising variant albumin or fragments thereof, fragment thereof, or a conjugate or nanoparticle or associate or composition comprising a variant of albumin or a fragment thereof according to the invention. A lower binding affinity indicates a shorter half-life, for example plasma half-life.

One advantage of the invention is that it allows the half-life of albumin, a variant of albumin or a fragment thereof or fusion polypeptides comprising variant albumin or fragments thereof, fragment thereof, conjugate, nanoparticle, associate or composition to be tailored in order to achieve a binding affinity or half-life which meets the needs of the user.

When determining and/or comparing KD, one or more (and preferably all) of the following parameters may be used:

Instrument: Biacore 3000 instrument (GE Healthcare)
Flow cell: CM5 sensor chip
FcRn: human FcRn, preferably soluble human FcRn, optionally coupled to a tag such as GST or His, most preferably His such as 6 histidines at the C-terminus of the beta-2-microglobulin (SEQ ID NO: 31).

Quantity of FcRn: 1200-2500 RU

Coupling chemistry: amine coupling chemistry (e.g. as described in the protocol provided by the manufacturer of the instrument).

Coupling method: The coupling may be performed by injecting 20 μg/ml of the protein in 10 mM sodium acetate pH 5.0 (GE Healthcare). Phosphate buffer (67 mM phosphate buffer, 0.15 M NaCl, 0.005% Tween 20) at pH 5.5) may be used as running buffer and dilution buffer. Regeneration of the surfaces may be done using injections of HBS-EP buffer (0.01 M HEPES, 0.15 M NaCl, 3 mM EDTA, 0.005% surfactant P20) at pH 7.4 (Biacore AB).

Quantity of injection of test molecule (e.g. HSA or variant) 20-0.032 μM

Flow rate of injection: constant, e.g. 30 μl/ml

Temperature of injection: 25° C.

Data evaluation software: BIAevaluation 4.1 software (BIAcore AB). The preferred method for determining KD is provided in Example 2.

The invention discloses that two or more positions selected among the group consisting of positions 492, 550, 573, 574 and 580 in SEQ ID NO: 2 (and therefore equivalent positions in albumins and fragments from human serum and albumin and non-human serum albumins) may be altered in order to modulate (increase of decrease) the binding affinity and/or half-life e.g. plasma half-life of an albumin, fragment, fusion, conjugate, associate, nanoparticle or composition. An alteration may be a substitution, insertion or deletion. Substitution is preferred.

A substitution or insertion may or may not comprise introduction of a conserved amino acid, i.e. conserved in relation to the amino acid at the position of interest. Examples of conserved amino acids are shown by the groups of FIG. 3: aliphatic, aromatic, hydrophobic, charged, polar, positive, tiny and small. At position 492 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to G, D, F, H, M or R, even more preferred to G or D and most preferred to G. In SEQ ID NO: 2 the native amino acid at position 492 is E, therefore a substitution to E is not preferred.

At position 550 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to K, L, M, E or R, even more preferred to K, L or M and most preferred to K. In SEQ ID NO: 2 the native amino acid at position 550 is D, therefore a substitution to D is not preferred.

At position 573 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to P, Y, W, H, F, T, I or V, even more preferred to P, Y or W and most preferred to P. In SEQ ID NO: 2 the native amino acid at position 573 is K, therefore a substitution to K is not preferred.

At position 574 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to D, F, G, H, N, S or Y, even more preferred to H, D, F or G and most preferred to H. In SEQ ID NO: 2 the native amino acid at position 574 is K, therefore a substitution to K is not preferred.

At position 580 of SEQ ID NO: 2 (or equivalent position of other albumins or variants or fragments thereof), it is preferred that the alteration is a substitution, such as from the native amino acid to A, C, D, E, F, G, H, I, K, L, M, N, P, Q, R, S, T, V, W, Y, more preferred to K or R, most preferred to K. In SEQ ID NO: 2 the native amino acid at position 580 is Q, therefore a substitution to Q is not preferred.

A variant albumin may comprise alterations at positions corresponding to positions 492+550 of SEQ ID NO: 2 (or equivalent position of other albumins or variants or fragments thereof). Such alterations may comprise 492D+550K (e.g. SEQ ID NO: 231), or 492G+550K (e.g. SEQ ID NO: 240).

A variant albumin may comprise alterations at positions corresponding to positions 492+573 of SEQ ID NO: 2 (or equivalent position of other albumins or variants or fragments thereof). Such alterations may comprise 492F+573P (e.g. SEQ ID NO: 109), 492G+573P (e.g. SEQ ID NO: 110), 492H+573P (e.g. SEQ ID NO: 111) or 492R+573P (e.g. SEQ ID NO: 113) or more preferably 492D+573P (e.g. SEQ ID NO: 108). However, it is preferred that the variant does not consist of SEQ ID NO: 2 with only alterations 492G+K573A, E492G+K573A, E492G+N503K+K573A, E492G+N503H+K573A, E492G+K573P, E492G+N503K+K573P or E492G+N503H+K573P.

A variant albumin may comprise alterations at positions corresponding to positions 492+574 of SEQ ID NO: 2 (or equivalent position of other albumins or variants or fragments thereof). Such alterations may comprise 492D+574H (e.g. SEQ ID NO: 232), 492G+574H (e.g. SEQ ID NO: 241) or 492D+574H (e.g. SEQ ID NO: 232).

A variant albumin may comprise alterations at positions corresponding to positions 492+580 of SEQ ID NO: 2 (or equivalent position of other albumins or variants or fragments thereof).

A variant albumin may comprise alterations at positions corresponding to positions 550+573 of SEQ ID NO: 2 (or equivalent position of other albumins or variants or fragments thereof). Such alterations may comprise D550K+K573P (e.g. SEQ ID NO: 117).

A variant albumin may comprise alterations at positions corresponding to positions 550+574 of SEQ ID NO: 2 (or equivalent position of other albumins or variants or fragments thereof). Such alterations may comprise 550K+574H (e.g. SEQ ID NO: 130), 550M+574H (e.g. SEQ ID NO: 249), 550M+574H (e.g. SEQ ID NO: 249) or 550L+574H (e.g. SEQ ID NO: 245).

A variant albumin may comprise alterations at positions corresponding to positions 550+580 of SEQ ID NO: 2 (or equivalent position of other albumins or variants or fragments thereof). Such alterations may comprise 550K+580K (e.g. SEQ ID NO: 131), 550M+580K (e.g. SEQ ID NO: 251) or 550L+580K (e.g. SEQ ID NO: 247).

A variant albumin may comprise alterations at positions corresponding to positions 573+574 of SEQ ID NO: 2 (or equivalent position of other albumins or variants or fragments thereof). Such alterations may comprise 574D+573P (e.g. SEQ ID NO: 121), 574F+573P (e.g. SEQ ID NO: 122), 574G+573P (e.g. SEQ ID NO: 123), 574H+573P (e.g. SEQ ID NO: 124), 574N+573P (e.g. SEQ ID NO: 125) or 574S+573P (e.g. SEQ ID NO: 126). It is preferred that the variant does not consist of SEQ ID NO:

2 with only alterations K573P+K574N+A577T+A578R+ S579C+Q580K+A581D+G584A.

A variant albumin may comprise alterations at positions corresponding to positions 573+580 of SEQ ID NO: 2 (or equivalent position of other albumins or variants or fragments thereof). Such alterations may comprise 580K+573P (e.g. SEQ ID NO: 128) or 580R+573P (e.g. SEQ ID NO: 129). However, it is preferred that the variant does not consist of SEQ ID NO: 2 with only alterations K573P+ A577E+A578S+Q580K+A582T.

A variant albumin may comprise alterations at positions corresponding to positions 574+580 of SEQ ID NO: 2 (or equivalent position of other albumins or variants or fragments thereof).

A variant albumin may comprise alterations at positions corresponding to positions 492+550+573 of SEQ ID NO: 2 (or equivalent position of other albumins or variants or fragments thereof). Such alterations may comprise 492G+ 550K+573P (e.g. SEQ ID NO: 254) or 492D+550K+573P (e.g. SEQ ID NO: 253).

A variant albumin may comprise alterations at positions corresponding to positions 492+550+574 of SEQ ID NO: 2 (or equivalent position of other albumins or variants or fragments thereof). Such alterations may comprise E492G+ D550K+K574H (e.g. SEQ ID NO: 255).

A variant albumin may comprise alterations at positions corresponding to positions 492+550+580 of SEQ ID NO: 2 (or equivalent position of other albumins or variants or fragments thereof). Such alterations may comprise 492D+ 550K+580K (e.g. SEQ ID NO: 258) or 492G+550K+580K (e.g. SEQ ID NO: 259).

A variant albumin may comprise alterations at positions corresponding to positions 492+573+574 of SEQ ID NO: 2 (or equivalent position of other albumins or variants or fragments thereof). Such alterations may comprise 492D+ 573P+574H (e.g. SEQ ID NO: 233).

A variant albumin may comprise alterations at positions corresponding to positions 492+573+580 of SEQ ID NO: 2 (or equivalent position of other albumins or variants or fragments thereof). Such alterations may comprise 492D+ 573P+580K (e.g. SEQ ID NO: 234) or 492G+573P+580K (e.g. SEQ ID NO: 242).

A variant albumin may comprise alterations at positions corresponding to positions 492+574+580 of SEQ ID NO: 2 (or equivalent position of other albumins or variants or fragments thereof). Such alterations may comprise 492D+ 574H+580K (SEQ ID NO: 262) or 492G+574H+580K (e.g. SEQ ID NO: 263).

A variant albumin may comprise alterations at positions corresponding to positions 550+573+574 of SEQ ID NO: 2 (or equivalent position of other albumins or variants or fragments thereof). Such alterations may comprise 550K+ 574H+573P (e.g. SEQ ID NO: 131), 550L+573P+574H (e.g. SEQ ID NO: 246) or 550M+573P+574H (e.g. SEQ ID NO: 250).

A variant albumin may comprise alterations at positions corresponding to positions 550+573+580 of SEQ ID NO: 2 (or equivalent position of other albumins or variants or fragments thereof). Such alterations may comprise 550L+ 573P+580K (e.g. SEQ ID NO: 248) or 550M+573P+580K (e.g. SEQ ID NO: 252).

A variant albumin may comprise alterations at positions corresponding to positions 550+574+580 of SEQ ID NO: 2 (or equivalent position of other albumins or variants or fragments thereof).

A variant albumin may comprise alterations at positions corresponding to positions 573+574+580 of SEQ ID NO: 2 (or equivalent position of other albumins or variants or fragments thereof). Such alterations may comprise 574H+ 580K+573P (e.g. SEQ ID NO: 135).

A variant albumin may comprise alterations at positions corresponding to positions 492+550+573+574 of SEQ ID NO: 2 (or equivalent position of other albumins or variants or fragments thereof). Such alterations may comprise 492G+ 550K+573P+574H (e.g. SEQ ID NO: 257) or 492D+550K+ 573P+574H (e.g. SEQ ID NO: 256).

A variant albumin may comprise alterations at positions corresponding to positions 492+550+573+580 of SEQ ID NO: 2 (or equivalent position of other albumins or variants or fragments thereof). Such alterations may comprise 492D+ 550K+573P+580K (e.g. SEQ ID NO: 260) or 492G+550K+ 573P+580K (e.g. SEQ ID NO: 261).

A variant albumin may comprise alterations at positions corresponding to positions 492+550+574+580 of SEQ ID NO: 2 (or equivalent position of other albumins or variants or fragments thereof).

A variant albumin may comprise alterations at positions corresponding to positions 492+573+574+580 of SEQ ID NO: 2 (or equivalent position of other albumins or variants or fragments thereof). Such alterations may comprise 492D+ 573P+574H+580K (e.g. SEQ ID NO: 114) or 492G+573P+ 574H+580K (e.g. SEQ ID NO: 115), 492F+573P+574G+ 580K
(e.g. SEQ ID NO: 238), 492G+573P+574G+580K (e.g. SEQ ID NO: 234), 492D+573P+574G+580K (e.g. SEQ ID NO: 235), 492F+573P+574H+580R (e.g. SEQ ID NO: 239), 492D+573P+574H+580K (e.g. SEQ ID NO: 264), 492G+ 573P+574H+580R (e.g. SEQ ID NO: 244), 492D+573P+ 574H+580R (e.g. SEQ ID NO: 236) or 492F+573P+574H+ 580K (e.g. SEQ ID NO: 237).

A variant albumin may comprise alterations at positions corresponding to positions 550+573+574+580 of SEQ ID NO: 2 (or equivalent position of other albumins or variants or fragments thereof). Such alterations may comprise 550K+ 573P+574H+580K (e.g. SEQ ID NO: 265).

A variant albumin may comprise alterations at positions corresponding to positions 492+550+573+574+580 of SEQ ID NO: 2 (or equivalent position of other albumins or variants or fragments thereof). Such alterations may comprise 492D+550K+573P+574H+580K (e.g. SEQ ID NO: 266) or 492G+550K+573P+574H+580K (e.g. SEQ ID NO: 267). Such alterations may comprise 492D+550K+573P+ 574H (e.g. SEQ ID NO: 256).

Particularly preferred variants include:

a variant albumin comprising alterations at positions corresponding to positions 492 and 580 in SEQ ID NO: 2, such as (i) E492G and Q580K, or (ii) E492D and Q580K (or equivalent positions of other albumins or variants or fragment thereof);

a variant albumin comprising alterations at positions corresponding to positions 492 and 574 in SEQ ID NO: 2, such as (i) E492G and K574H, (ii) E492D and K574H, (iii) E492D and K574K, or (iv) E492G and K574K (or equivalent positions of other albumins or variants or fragment thereof);

a variant albumin comprising alterations at positions corresponding to positions 492 and 550 in SEQ ID NO: 2, such as (i) E492G and D550K, or (ii) E492D and D550K (or equivalent positions of other albumins or variants or fragment thereof);

a variant albumin comprising alterations at positions corresponding to positions 550 and 573 in SEQ ID NO: 2, such as (i) D550K and K573P, (ii) D550L and K573P or (iii)

D550M and K573P (or equivalent positions of other albumins or variants or fragment thereof);

a variant albumin comprising alterations at positions corresponding to positions 550 and 574 in SEQ ID NO: 2, such as (i) D550K and K574H, or (ii) D550L and K574H (or equivalent positions of other albumins or variants or fragment thereof);

a variant albumin comprising alterations at positions corresponding to positions 550 and 580 in SEQ ID NO: 2, such as (i) D550M and Q580K, (ii) D550L and Q580K or (iii) D550K and Q580K (or equivalent positions of other albumins or variants or fragment thereof);

a variant albumin with alterations (e.g. comprising alterations) at positions corresponding to positions 580 and 573 in SEQ ID NO: 2, such as Q580K and K573P (or equivalent positions of other albumins or variants or fragment thereof) and preferably one or more (several) other alterations such at a position selected from 492, 550 and 574. If there is a K at position 580 and a P at position 573 it is preferred that the polypeptide comprises an additional alteration at a position selected from the group consisting of 492, 550,and 574.

a variant albumin with alterations (e.g. comprising alterations) at positions corresponding to positions 492 and 573 in SEQ ID NO: 2, such as a variant albumin comprising alterations at positions corresponding to positions 492 and 573 in SEQ ID NO: 2, such as (i) E492D and K573P or (ii) E492G and K573P or (iii) E492G and K573A (or equivalent positions of other albumins or variants or fragment thereof), and preferably one or more (several) other alterations such at a position selected from 550, 574 and 580. If there is a G at position 492 and an A or P at position 573 it is preferred that the polypeptide comprises an additional alteration at a position selected from the group consisting of 550, 574 and 580 (or equivalent positions of other albumins or variants or fragment thereof);

a variant albumin with alterations (e.g. comprising alterations) at positions corresponding to positions 573 and 574 in SEQ ID NO: 2, such as K573P and K574H (or equivalent positions of other albumins or variants or fragment thereof, and preferably one or more (several) alterations such as at a position selected from 492, 550 and 580. If there is a P at position 573 and an N at position 574 it is preferred that the polypeptide comprises an additional alteration at a position selected from the group consisting of 492, 550, and 580 (or equivalent positions of other albumins or variants or fragment thereof);

a variant albumin comprising alterations at positions corresponding to positions 574 and 580 in SEQ ID NO: 2, such as 574H and 580K (or equivalent positions of other albumins or variants or fragment thereof. If there is a N at position 574 and a K at position 580 it is preferred that the polypeptide comprises an additional alteration at a position selected from the group consisting of 492, 550, and 573 (or equivalent positions of other albumins or variants or fragment thereof);

a variant albumin comprising alterations at positions corresponding to positions 492, 550 and 573 in SEQ ID NO: 2, such as E492G, D550K and K573P e.g. SEQ ID NO: 254 or such as E492D, D550K and K573P e.g. SEQ ID NO: 253;

a variant albumin comprising alterations at positions corresponding to positions 550, 573 and 580 in SEQ ID NO: 2, such as D550K, K573P and Q580K e.g. SEQ ID NO: 133;

a variant albumin comprising alterations at positions corresponding to positions 550, 573 and 580 in SEQ ID NO: 2, such as D550L, K573P and Q580K e.g. SEQ ID NO: 248 or such as D550M, K573P and Q580K e.g. SEQ ID NO: 252;

a variant albumin comprising alterations at positions corresponding to positions 550, 573 and 574 in SEQ ID NO: 2, such as D550L, K573P and K574H e.g. SEQ ID NO:246;

a variant albumin comprising alterations at positions corresponding to positions 550, 573 and 574 in SEQ ID NO: 2, such as D550K, K573P and K574H e.g. SEQ ID NO: 131;

a variant albumin comprising alterations at positions corresponding to positions 492, 573 and 580 in SEQ ID NO: 2, such as E492G, K573P and Q580K e.g. SEQ ID NO: 242;

a variant albumin comprising alterations at positions corresponding to positions 492, 573 and 580 in SEQ ID NO: 2, such as E492D, K573P and Q580K e.g. SEQ ID NO: 234;

a variant albumin comprising alterations at positions corresponding to positions 492, 550, 573 and 574 in SEQ ID NO: 2, such as E492D, D550K, K573P and K574H e.g. SEQ ID NO: 256;

a variant albumin comprising alterations at positions corresponding to positions 492, 550, 573 and 574 in SEQ ID NO: 2, such as E492G, D550K, K573P and K574H e.g. SEQ ID NO: 257;

a variant albumin comprising alterations at positions corresponding to positions 573, 574 and 580 in SEQ ID NO: 2, such as K573P, K574H and Q580K e.g. SEQ ID NO: 135;

a variant albumin comprising alterations at positions corresponding to positions 492, 573, 574 and 580 in SEQ ID NO: 2, such as E492D, K573P, K574H and Q580K (or equivalent positions of other albumins or variants or fragment thereof), e.g. SEQ ID NO: 114;

a variant albumin comprising alterations at positions corresponding to positions 492, 573, 574 and 580 in SEQ ID NO: 2, such as E492G, K573P, K574H and Q580K (or equivalent positions of other albumins or variants or fragment thereof), e.g. SEQ ID NO: 115.

It is preferred that the alteration at position 492 is conserved relative to D or E. It is preferred that the alteration at position 574 is conserved relative to H. It is preferred that the alteration at position 580 is conserved relative to K.

Advantageously, the polypeptide retains substantially the same tertiary structure (or, for a fragment, the relevant part of the structure) as a reference or parent albumin such as HSA. The skilled person understand the term 'substantially the same tertiary structure' bearing in mind that some degree of variation in tertiary structure is expected as all proteins have some degree of structural flexibility. This applies particularly to polypeptides having a higher binding affinity to FcRn than the parent or reference albumin (e.g. HSA) has to FcRn.

One or more (several) of the His residues may or may not be maintained relative to the parent albumin. For example, with reference to SEQ ID NO: 2, one or more (several) of the following His residues may be maintained: 3, 9, 39, 67, 105, 128, 146, 242, 247, 288, 338, 367, 440, 464, 510, 535. One or more (several), preferably all, of the His residues in domain I are maintained (i.e. 3, 9, 39, 67, 105, 128, 146.). One or more (several), preferably all, of the His residues in domain II are maintained (i.e. 242, 247, 288, 338, 367). One or more (several), preferably all, of the His residues in domain III are maintained (i.e. 440, 464, 510, 535). One or more (several) or all three of His 464, 510, 535 may be maintained.

It is preferred that at least 1, 2, 3, 4, 5, 6, 7, 8, 9, 10, 11, 12, 13, 14, 15, 16 or 17 of the disulphide bonds of the albumin are maintained in the polypeptide. For a polypeptide derived from a full length albumin, it is preferred that all disulphide bonds usually present in that albumin are maintained. For a polypeptide derived from a fragment of albumin, it is preferred that all disulphide bonds usually present in that fragment are maintained. It is preferred that Cys34 (or equivalent in non-human albumins) is maintained.

For all aspects of the invention fusion partner polypeptides and/or conjugates may comprise one or more (several) of: 4-1BB ligand, 5-helix, A human C-C chemokine, A human L105 chemokine, A human L105 chemokine designated huL105_3., A monokine induced by gamma-interferon (MIG), A partial CXCR4B protein, A platelet basic protein (PBP), α1-antitrypsin, ACRP-30 Homologue; Complement Component C1q C, Adenoid-expressed chemokine (ADEC), aFGF; FGF-1, AGF, AGF Protein, albumin, an etoposide, angiostatin, Anthrax vaccine, Antibodies specific for collapsin, antistasin, Anti-TGF beta family antibodies, antithrombin III, APM-1; ACRP-30; Famoxin, apo-lipoprotein species, Arylsulfatase B, b57 Protein, BCMA, Beta-thromboglobulin protein (beta-TG), bFGF; FGF2, Blood coagulation factors, BMP Processing Enzyme Furin, BMP-10, BMP-12, BMP-15, BMP-17, BMP-18, BMP-2B, BMP-4, BMP-5, BMP-6, BMP-9, Bone Morphogenic Protein-2, calcitonin, Calpain-10a, Calpain-10b, Calpain-10c, Cancer Vaccine, Carboxypeptidase, C-C chemokine, MCP2, CCR5 variant, CCR7, CCR7, CD11a Mab, CD137; 4-1BB Receptor Protein, CD20 Mab, CD27, CD27L, CD30, CD30 ligand, CD33 immunotoxin, CD40, CD40L, CD52 Mab, Cerebus Protein, Chemokine Eotaxin., Chemokine hIL-8, Chemokine hMCP1, Chemokine hMCP1a, Chemokine hMCP1b, Chemokine hMCP2, Chemokine hMCP3, Chemokine hSDF1b, Chemokine MCP-4, chemokine TECK and TECK variant, Chemokine-like protein IL-8M1 Full-Length and Mature, Chemokine-like protein IL-8M10 Full-Length and Mature, Chemokine-like protein IL-8M3, Chemokine-like protein IL-8M8 Full-Length and Mature, Chemokine-like protein IL-8M9 Full-Length and Mature, Chemokine-like protein PF4-414 Full-Length and Mature, Chemokine-like protein PF4-426 Full-Length and Mature, Chemokine-like protein PF4-M2 Full-Length and Mature, Cholera vaccine, Chondromodulin-like protein, c-kit ligand; SCF; Mast cell growth factor; MGF; Fibrosarcoma-derived stem cell factor, CNTF and fragment thereof (such as CNTFAx15' (Axokine™)), coagulation factors in both pre and active forms, collagens, Complement C5 Mab, Connective tissue activating protein-III, CTAA16.88 Mab, CTAP-III, CTLA4-Ig, CTLA-8, CXC3, CXC3, CXCR3; CXC chemokine receptor 3, cyanovirin-N, Darbepoetin, designated exodus, designated huL105_7., DIL-40, DNase, EDAR, EGF Receptor Mab, ENA-78, Endostatin, Eotaxin, Epithelial neutrophil activating protein-78, EPO receptor; EPOR, erythropoietin (EPO) and EPO mimics, Eutropin, Exodus protein, Factor IX, Factor VII, Factor VIII, Factor X and Factor XIII, FAS Ligand Inhibitory Protein (DcR3), FasL, FasL, FasL, FGF, FGF-12; Fibroblast growth factor homologous factor-1, FGF-15, FGF-16, FGF-18, FGF-3; INT-2, FGF-4; gelonin, HST-1; HBGF-4, FGF-5, FGF-6; Heparin binding secreted transforming factor-2, FGF-8, FGF-9; Glia activating factor, fibrinogen, flt-1, flt-3 ligand, Follicle stimulating hormone Alpha subunit, Follicle stimulating hormone Beta subunit, Follitropin, Fractalkine, fragment. myofibrillar protein Troponin I, FSH, Galactosidase, Galectin-4, G-CSF, GDF-1, Gene therapy, Glioma-derived growth factor, glucagon, glucagon-like peptides, Glucocerebrosidase, glucose oxidase, Glucosidase, Glycodelin-A; Progesterone-associated endometrial protein, GM-CSF, gonadotropin, Granulocyte chemotactic protein-2 (GCP-2), Granulocyte-macrophage colony stimulating factor, growth hormone, Growth related oncogene-alpha (GRO-alpha), Growth related oncogene-beta (GRO-beta), Growth related oncogene-gamma (GRO-gamma), hAPO-4; TROY, hCG, Hepatitus B surface Antigen, Hepatitus B Vaccine, HER2 Receptor Mab, hirudin, HIV gp120, HIV gp41, HIV Inhibitor Peptide, HIV Inhibitor Peptide, HIV Inhibitor Peptide, HIV protease inhibiting peptides, HIV-1 protease inhibitors, HPV vaccine, Human 6CKine protein, Human Act-2 protein, Human adipogenesis inhibitory factor, human B cell stimulating factor-2 receptor, Human beta-chemokine H1305 (MCP-2), Human C-C chemokine DGWCC, Human CC chemokine ELC protein, Human CC type chemokine interleukin C, Human CCC3 protein, Human CCF18 chemokine, Human CC-type chemokine protein designated SLC (secondary lymphoid chemokine), Human chemokine beta-8 short forms, Human chemokine C10, Human chemokine CC-2, Human chemokine CC-3, Human chemokine CCR-2, Human chemokine Ckbeta-7, Human chemokine ENA-78, Human chemokine eotaxin, Human chemokine GRO alpha, Human chemokine GROalpha, Human chemokine GRObeta, Human chemokine HCC-1, Human chemokine HCC-1, Human chemokine 1-309, Human chemokine IP-10, Human chemokine L105_3, Human chemokine L105_7, Human chemokine MIG, Human chemokine MIG-beta protein, Human chemokine MIP-1alpha, Human chemokine MIP1beta, Human chemokine MIP-3alpha, Human chemokine MIP-3beta, Human chemokine PF4, Human chemokine protein 331D5, Human chemokine protein 61164, Human chemokine receptor CXCR3, Human chemokine SDF1alpha, Human chemokine SDF1beta, Human chemokine ZSIG-35, Human Chr19Kine protein, Human CKbeta-9, Human CKbeta-9, Human CX3C 111 amino acid chemokine, Human DNAX interleukin-40, Human DVic-1 C-C chemokine, Human EDIRF I protein sequence, Human EDIRF II protein sequence, Human eosinocyte CC type chemokine eotaxin, Human eosinophil-expressed chemokine (EEC), Human fast twitch skeletal muscle troponin C, Human fast twitch skeletal muscle troponin I, Human fast twitch skeletal muscle Troponin subunit C, Human fast twitch skeletal muscle Troponin subunit I Protein, Human fast twitch skeletal muscle Troponin subunit T, Human fast twitch skeletal muscle troponin T, Human foetal spleen expressed chemokine, FSEC, Human GM-CSF receptor, Human gro-alpha chemokine, Human gro-beta chemokine, Human gro-gamma chemokine, Human IL-16 protein, Human IL-1RD10 protein sequence, Human IL-1RD9, Human IL-5 receptor alpha chain, Human IL-6 receptor, Human IL-8 receptor protein hIL8RA, Human IL-8 receptor protein hIL8RB, Human IL-9 receptor protein, Human IL-9 receptor protein variant #3, Human IL-9 receptor protein variant fragment, Human IL-9 receptor protein variant fragment #3, Human interleukin 1 delta, Human Interleukin 10, Human Interleukin 10, Human interleukin 18, Human interleukin 18 derivatives, Human interleukin-1 beta precursor, Human interleukin-1 beta precursor., Human interleukin-1 receptor accessory protein, Human interleukin-1 receptor antagonist beta, Human interleukin-1 type-3 receptor, Human Interleukin-10 (precursor), Human Interleukin-10 (precursor), Human interleukin-11 receptor, Human interleukin-12 40 kD subunit, Human interleukin-12 beta-1 receptor, Human interleukin-12 beta-2 receptor, Human Interleukin-12 p35 protein, Human Interleukin-12 p40 protein, Human interleukin-12 receptor, Human interleukin-13 alpha receptor, Human interleukin-13 beta receptor, Human interleukin-15, Human interleukin-15 receptor from clone P1, Human interleukin-17 receptor, Human interleukin-18 protein (IL-18), Human interleukin-3, human interleukin-3 receptor, Human interleukin-3 variant, Human interleukin-4 receptor, Human interleukin-5, Human interleukin-6, Human interleukin-7, Human interleukin-7., Human interleukin-8 (IL-8), Human intracellular IL-1 receptor antagonist, Human IP-10 and HIV-1 gp120 hypervariable region fusion protein, Human IP-10 and human Muc-1 core epitope (VNT) fusion protein, human liver and activation regulated chemokine (LARC), Human Lkn-1 Full-Length and Mature protein, Human mammary associated chemokine (MACK) protein Full-Length and Mature, Human mature chemokine Ckbeta-7, Human mature gro-alpha, Human mature gro-gamma polypeptide used to treat sepsis, Human MCP-3 and human Muc-1 core epitope (VNT) fusion protein, Human MI10 protein, Human MI1A protein, Human monocyte chemoattractant factor hMCP-1, Human monocyte chemoattractant factor hMCP-3, Human monocyte chemotactic proprotein (MCPP) sequence, Human neurotactin chemokine like domain, Human non-ELR CXC chemokine H174, Human non-ELR CXC chemokine IP10, Human non-ELR CXC chemokine Mig, Human PAI-1 mutants, Human protein with IL-16 activity, Human protein with IL-16 activity, Human secondary lymphoid chemokine (SLC), Human SISD protein, Human STCP-1, Human stromal cell-derived chemokine, SDF-1, Human T cell mixed lymphocyte reaction expressed chemokine (TMEC), Human thymus and activation regulated cytokine (TARC), Human thymus expressed, Human TNF-alpha, Human TNF-alpha, Human TNF-beta (LT-alpha), Human type CC chemokine eotaxin 3 protein sequence, Human type II interleukin-1 receptor, Human wild-type interleukin-4 (hIL-4) protein, Human ZCHEMO-8 protein, Humanized Anti-VEGF Antibodies, and fragments thereof, Humanized Anti-VEGF Antibodies, and fragments thereof, Hyaluronidase, ICE 10 kD subunit., ICE 20 kD subunit., ICE 22 kD subunit., Iduronate-2-sulfatase, Iduronidase, IL-1 alpha, IL-1 beta, IL-1 inhibitor (IL-1i)., IL-1 mature, IL-10 receptor, IL-11, IL-11, IL-12 p40 subunit., IL-13, IL-14, IL-15, IL-15 receptor, IL-17, IL-17 receptor, II-17 receptor, II-17 receptor, IL-19, IL-1i fragments, IL1-receptor antagonist, IL-21 (TIF), IL-3 containing fusion protein., IL-3 mutant proteins, IL-3 variants, IL-3 variants, IL-4, IL-4 mutein, IL-4 mutein Y124G, IL-4 mutein Y124X, IL-4 muteins, II-5 receptor, IL-6, II-6 receptor, IL-7 receptor clone, IL-8 receptor, IL-9 mature protein variant (Met117 version), immunoglobulins or immunoglobulin-based molecules or fragment of either (e.g. a Small Modular ImmunoPharmaceutical™ ("SMIP") or dAb, Fab' fragments, F(ab')2, scAb, scFv or scFv fragment), including but not limited to plasminogen, Influenza Vaccine, Inhibin alpha, Inhibin beta, insulin, insulin-like growth factor, Integrin Mab, inter-alpha trypsin inhibitor, inter-alpha trypsin inhibitor, Interferon gamma-inducible protein (IP-10), interferons (such as interferon alpha species and sub-species, interferon beta species and sub-species, interferon gamma species and sub-species), interferons (such as interferon alpha species and sub-species, interferon beta species and sub-species, interferon gamma species and sub-species), Interleukin 6, Interleukin 8 (IL-8) receptor, Interleukin 8 receptor B, Interleukin-1alpha, Interleukin-2 receptor associated protein p43, interleukin-3, interleukin-4 muteins, Interleukin-8 (IL-8) protein., interleukin-9, Interleukin-9 (IL-9) mature protein (Thr117 version), interleukins (such as IL10, IL11 and IL2), interleukins (such as IL10, IL11 and IL2), Japanese encephalitis vaccine, Kalikrein Inhibitor, Keratinocyte growth factor, Kunitz domain protein (such as aprotinin, amyloid precursor protein and those described in WO 03/066824, with or without albumin fusions), Kunitz domain protein (such as aprotinin, amyloid precursor protein and those described in WO 03/066824, with or without albumin fusions), LACI, lactoferrin, Latent TGF-beta binding protein II, leptin, Liver expressed chemokine-1 (LVEC-1), Liver expressed chemokine-2 (LVEC-2), LT-alpha, LT-beta, Luteinization Hormone, Lyme Vaccine, Lymphotactin, Macrophage derived chemokine analogue MDC (n+1), Macrophage derived chemokine analogue MDC-eyfy, Macrophage derived chemokine analogue MDC-yl, Macrophage derived chemokine, MDC, Macrophage-derived chemokine (MDC), Maspin; Protease Inhibitor 5, MCP-1 receptor, MCP-1a, MCP-1b, MCP-3, MCP-4 receptor, M-CSF, Melanoma inhibiting protein, Membrane-bound proteins, Met117 human interleukin 9, MIP-3 alpha, MIP-3 beta, MIP-Gamma, MIRAP, Modified Rantes, monoclonal antibody, MP52, Mutant Interleukin 6 S176R, myofibrillar contractile protein Troponin I, Natriuretic Peptide, Nerve Growth Factor-beta, Nerve Growth Factor-beta2, Neuropilin-1, Neuropilin-2, Neurotactin, Neurotrophin-3, Neurotrophin-4, Neurotrophin-4a, Neurotrophin-4b, Neurotrophin-4c, Neurotrophin-4d, Neutrophil activating peptide-2 (NAP-2), NOGO-66 Receptor, NOGO-A, NOGO-B, NOGO-C, Novel beta-chemokine designated PTEC, N-terminal modified chemokine GroHEK/hSDF-1alpha, N-terminal modified chemokine GroHEK/hSDF-1beta., N-terminal modified chemokine met-hSDF-1 alpha, N-terminal modified chemokine met-hSDF-1 beta, OPGL, Osteogenic Protein-1; OP-1; BMP-7, Osteogenic Protein-2, OX40; ACT-4, OX40L, Oxytocin (Neurophysin I), parathyroid hormone, Patched, Patched-2, PDGF-D, Pertussis toxoid, Pituitary expressed chemokine (PGEC), Placental Growth Factor, Placental Growth Factor-2, Plasminogen Activator Inhibitor-1; PAI-1, Plasminogen Activator Inhibitor-2; PAI-2, Plasminogen Activator Inhibitor-2; PAI-2, Platelet derived growth factor, Platelet derived growth factor Bv-sis, Platelet derived growth factor precursor A, Platelet derived growth factor precursor B, Platelet Mab, platelet-derived endothelial cell growth factor (PD-ECGF), Platelet-Derived Growth Factor A chain, Platelet-Derived Growth Factor B chain, polypeptide used to treat sepsis, Preproapolipoprotein "milano" variant, Preproapolipoprotein "paris" variant, pre-thrombin, Primate CC chemokine "ILINCK", Primate CXC chemokine "IBICK", proinsulin, Prolactin, Prolactin2, pro-saptide, Protease inhibitor peptides, Protein C, Protein S, pro-thrombin, prourokinase, RANTES, RANTES 8-68, RANTES 9-68, RANTES peptide, RANTES receptor, Recombinant interleukin-16, Resistin, restrictocin, Retroviral protease inhibitors, ricin, Rotavirus Vaccine, RSV Mab, saporin, sarcin, Secreted and Transmembrane polypeptides, Secreted and Transmembrane polypeptides, serum cholinesterase, serum protein (such as a blood clotting factor), Soluble BMP Receptor Kinase Protein-3, Soluble VEGF Receptor, Stem Cell Inhibitory Factor, Straphylococcus Vaccine, Stromal Derived Factor-1 alpha, Stromal Derived Factor-1 beta, Substance P (tachykinin), T1249 peptide, T20 peptide, T4 Endonuclease, TACI, Tarc, TGF-beta 1, TGF-beta 2, Thr117 human interleukin 9, thrombin, thrombopoietin, Thrombopoietin derivative1, Thrombopoietin derivative2, Thrombopoietin derivative3, Thrombopoietin derivative4, Thrombopoietin derivative5, Thrombopoietin derivative6, Thrombopoietin derivative7, Thymus expressed chemokine (TECK), Thyroid stimulating Hormone, tick anticoagulant peptide, Tim-1 protein, TNF-alpha precursor, TNF-R, TNF-RII; TNF p75 Receptor; Death Receptor, tPA, transferrin, transforming growth factor beta, Troponin peptides, Truncated monocyte chemotactic protein 2 (6-76), Truncated monocyte chemotactic protein 2 (6-76), Truncated RANTES protein (3-68), tumour necrosis factor, Urate Oxidase, urokinase, Vasopressin (Neurophysin II), VEGF R-3; flt-4, VEGF Receptor; KDR; flk-1, VEGF-110, VEGF- 121, VEGF-138, VEGF-145, VEGF-162, VEGF-165, VEGF-182, VEGF-189, VEGF-206, VEGF-D, VEGF-E; VEGF-X, von Willebrand's factor, Wild type monocyte chemotactic protein 2, Wild type monocyte chemotactic protein 2, ZTGF-beta 9, alternative antibody scaffolds e.g. anticalin(s), adnectin(s), fibrinogen fragment(s), nanobodies such as camelid nanobodies, infestin, and/or any of the molecules mentioned in WO01/79271 (particularly page 9 and/or Table 1), WO 2003/59934 (particularly Table 1), WO03/060071 (particularly Table 1) or WO01/079480 (particularly Table 1) (each incorporated herein by reference in their entirety).

Furthermore, conjugates may comprise one or more (several) of chemotherapy drugs such as: 13-cis-Retinoic Acid, 2-CdA, 2-Chlorodeoxyadenosine, 5-Azacitidine, 5-Fluorouracil, 5-FU, 6-Mercaptopurine, 6-MP, 6-TG, 6-Thioguanine, A, Abraxane, Accutane®, Actinomycin-D, Adriamycin®, Adrucil®, Agrylin®, Ala-Cort®, Aldesleukin, Alemtuzumab, ALIMTA, Alitretinoin, Alkaban-AQ®, Alkeran®, All-transretinoic Acid, Alpha Interferon, Altretamine, Amethopterin, Amifostine, Aminoglutethimide, Anagrelide, Anandron®, Anastrozole, Arabinosylcytosine, Ara-C, Aranesp®, Aredia®, Arimidex®, Aromasin®, Arranon®, Arsenic Trioxide, Asparaginase, ATRA, Avastin®, Azacitidine, BCG, BCNU, Bevacizumab, Bexarotene, BEXXAR®, Bicalutamide, BiCNU, Blenoxane®, Bleomycin, Bortezomib, Busulfan, Busulfex®, C225, Calcium Leucovorin, Campath®, Camptosar®, Camptothecin-11, Capecitabine, Carac™, Carboplatin, Carmustine, Carmustine Wafer, Casodex®, CC-5013, CCNU, CDDP, CeeNU, Cerubidine®, Cetuximab, Chlorambucil, Cisplatin, Citrovorum Factor, Cladribine, Cortisone, Cosmegen®, CPT-11, Cyclophosphamide, Cytadren®, Cytarabine, Cytarabine Liposomal, Cytosar-U®, Cytoxan®, Dacarbazine, Dacogen, Dactinomycin, Darbepoetin Alfa, Dasatinib, Daunomycin, Daunorubicin, Daunorubicin Hydrochloride, Daunorubicin Liposomal, DaunoXome®, Decadron, Decitabine, Delta-Cortef®, Deltasone®, Denileukin diftitox, DepoCyt™, Dexamethasone, Dexamethasone acetate, Dexamethasone Sodium Phosphate, Dexasone, Dexrazoxane, DHAD, DIC, Diodex, Docetaxel, Doxil®, Doxorubicin, Doxorubicin liposomal, Droxia™, DTIC, DTIC-Dome®, Duralone®, Efudex®, Eligard™, Ellence™, Eloxatin™, Elspar®, Emcyt®, Epirubicin, Epoetin alfa, Erbitux™, Erlotinib, Erwinia L-asparaginase, Estramustine, Ethyol, Etopophos®, Etoposide, Etoposide Phosphate, Eulexin®, Evista®, Exemestane, Fareston®, Faslodex®, Femara®, Filgrastim, Floxuridine, Fludara®, Fludarabine, Fluoroplex®, Fluorouracil, Fluorouracil (cream), Fluoxymesterone, Flutamide, Folinic Acid, FUDR®, Fulvestrant, G-CSF, Gefitinib, Gemcitabine, Gemtuzumab ozogamicin, Gemzar®, Gleevec™, Gliadel® Wafer, GM-CSF, Goserelin, Granulocyte—Colony Stimulating Factor, Granulocyte Macrophage Colony Stimulating Factor, Halotestin®, Herceptin®, Hexadrol, Hexalen®, Hexamethylmelamine, HMM, Hycamtin®, Hydrea®, Hydrocort Acetate®, Hydrocortisone, Hydrocortisone Sodium Phosphate, Hydrocortisone Sodium Succinate, Hydrocortone Phosphate, Hydroxyurea, Ibritumomab, Ibritumomab Tiuxetan, Idamycin®, Idarubicin, Ifex®, IFN-alpha, Ifosfamide, IL-11, IL-2, Imatinib mesylate, Imidazole Carboxamide, Interferon alfa, Interferon Alfa-2b (PEG Conjugate), Interleukin-2, Interleukin-11, Intron A® (interferon alfa-2b), Iressa®, Irinotecan, Isotretinoin, Kidrolase®, Lanacort®, Lapatinib, L-asparaginase, LCR, Lenalidomide, Letrozole, Leucovorin, Leukeran, Leukine™, Leuprolide, Leurocristine, Leustatin™, Liposomal Ara-C, Liquid Pred®, Lomustine, L-PAM, L-Sarcolysin, Lupron®, Lupron Depot®, M, Matulane®, Maxidex, Mechlorethamine, Mechlorethamine Hydrochloride, Medralone®, Medrol®, Megace®, Megestrol, Megestrol Acetate, Melphalan, Mercaptopurine, Mesna, Mesnex™, Methotrexate, Methotrexate Sodium, Methylprednisolone, Meticorten®, Mitomycin, Mitomycin-C, Mitoxantrone, M-Prednisol®, MTC, MTX, Mustargen®, Mustine, Mutamycin®, Myleran®, Mylocel™, Mylotarg®, Navelbine®, Nelarabine, Neosar®, Neulasta™, Neumega®, Neupogen®, Nexavar®, Nilandron®, Nilutamide, Nipent®, Nitrogen Mustard, Novaldex®, Novantrone®, Octreotide, Octreotide acetate, Oncospar®, Oncovin®, Ontak®, Onxal™, Oprevelkin, Orapred®, Orasone®, Oxaliplatin, a taxol or taxol derivative e.g. Paclitaxel or Paclitaxel Protein-bound, Pamidronate, Panitumumab, Panretin®, Paraplatin®, Pediapred®, PEG Interferon, Pegaspargase, Pegfilgrastim, PEG-INTRON™, PEG-L-asparaginase, PEMETREXED, Pentostatin, Phenylalanine Mustard, Platinol®, Platinol-AQ®, Prednisolone, Prednisone, Prelone®, Procarbazine, PROCRIT®, Proleukin®, Prolifeprospan 20 with Carmustine Implant, Purinethol®, R, Raloxifene, Revlimid®, Rheumatrex®, Rituxan®, Rituximab, Roferon-A® (Interferon Alfa-2a), Rubex®, Rubidomycin hydrochloride, Sandostatin®, Sandostatin LAR®, Sargramostim, Solu-Cortef®, Solu-Medrol®, Sorafenib, SPRYCEL™, STI-571, Streptozocin, SU11248, Sunitinib, Sutent®, Tamoxifen, Tarceva®, Targretin®, Taxol®, Taxotere®, Temodar®, Temozolomide, Teniposide, TESPA, Thalidomide, Thalomid®, TheraCys®, Thioguanine, Thioguanine Tabloid®, Thiophosphoamide, Thioplex®, Thiotepa, TICE®, Toposar®, Topotecan, Toremifene, Tositumomab, Trastuzumab, Tretinoin, Trexall™, Trisenox®, TSPA, TYKERB®, VCR, Vectibix™, Velban®, Velcade®, VePesid®, Vesanoid®, Viadur™, Vidaza®, Vinblastine, Vinblastine Sulfate, Vincasar Pfs®, Vincristine, Vinorelbine, Vinorelbine tartrate, VLB, VM-26, Vorinostat, VP-16, Vumon®, Xeloda®, Zanosar®, Zevalin™, Zinecard®, Zoladex®, Zoledronic acid, Zolinza, Zometa®; radiopharmaceuticals such as: Carbon-11, Carbon-14, Chromium-51, Cobalt-57, Cobalt-58, Erbium-169, Fluorine-18, Gallium-67, Gold-198, Indium-111, Indium-113m, Iodine-123, Iodine-125, Iodine-131, Iron-59, Krypton-81m, Nitrogen-13, Oxygen-15, Phosphorous-32, Rhenium-186, Rubidium-82, Samarium-153, Selenium-75, Strontium-89, Technetium-99m, Thallium-201, Tritium, Xenon-127, Xenon-133, Yttrium-90; imaging agents such as Gadolinium, magnetite, manganese, technetium, I125, I131, P32, TI201, Iopamidol, PET-FDG.

Further fusion partners, conjugation partners and/or molecules for inclusion in a nanoparticle, associate or composition according to the invention include: acromegaly drugs e.g. somatuline, lanreotide, octreotide, Sandostatin; anti-thrombotics e.g. bivalirudin, Angiomax, dalteparin, Fragmin, enoxaparin, Lovenox, Drotrecogin alfa (e.g. Activated), Xigris, heparin; assisted reproductive therapy compounds e.g. choriogonadotropin, Ovidrel, follitropin, alpha/beta; enzymes e.g. hyaluronidase, Hylenex; diabetes drugs e.g. exenatide, Byetta, glucagon, insulin, liraglutide, albiglutide, GLP-1 agonists, exendin or an exendin analog; compounds useful in diagnosis e.g. protirelin, Thyrel TRH Thypinone, secretin (e.g. synthetic human), Chirhostim, thyrotropin (e.g. alpha), Thyrogen' erythropoiesis drugs e.g. Darbepoetin alfa, Aranesp, Epoetin alfa, Epogen, Eprex, drugs for the treatment of genetic defects e.g. pegademase, drugs for the treatment of growth failure e.g. Adagen, mecasermin, rinfabate, drugs for the treatment of cystic fibrosis e.g. Dornase alfa, Pulmozyme, drugs for the treatment of metaoblic disorders e.g. Agalsidase beta, Fabrazyme, alglucosidase alpha, Myozyme, Laronidase, Aldurazyme, drugs for the treatment of genital wart intralesional e.g. Interferon alfa-n3, Alferon N, drugs for the treatment of granulomatous disease e.g. Interferon gamma-1b, Actimmune; drugs for the treatment of growth failure e.g. pegvisomant, Somavert, somatropin, Genotropin, Nutropin, Humatrope, Serostim, Protropin; drugs for the treatment of heart failure e.g. nesiritide, Natrecor; drugs for the treatment of hemophilia e.g. a coagulation factor e.g. Factor VIII, Helixate FS, Kogenate FS, Factor IX, BeneFIX, Factor VIIa, Novoseven, desmopressin, Stimate, DDAVP; hemopoetic drugs e.g. Filgrastim (G-CSF), Neupogen, Oprelvekin, Neumega, Pegfilgrastim, Neulasta, Sargramostim, Leukine; drugs for the treatment of hepatitis C e.g. Interferon alfa-2a, Roferon A, Interferon alfa-2b, Intron A, Interferon alfacon-1, Infergen, Peginterferon alfa-2a, Pegasys, Peginterferon alfa-2b, PEG-Intron; drugs for the treatment of HIV e.g. enfuvirtide, Fuzeon; Fabs e.g. Fab (antithrombin), Abciximab, ReoPro; monoclonal antibodies e.g. Daclizumab, Zenapax; antiviral monoclonal antibodies e.g. Palivizumab, Synagis; monoclonal antibodies for the treatment of asthma e.g. Omalizumab, Xolair; monoclonal antibodies for use in diagnostic imaging e.g. Arcitumomab, CEA-Scan, Capromab Pendetide, ProstaScint, Satumomab Pendetide, OncoScint CR/OV, Fabs for use in diagnostic imaging e.g. Nofetumomab, Verluma; immuno-suppressant monoclonal antibodies e.g. Basiliximab, Simulect, Muromonab-CD3, Orthoclone OKT3; monoclonal antibodies for the treatment of malignancy e.g. Alemtuzumab, Campath, Ibritumomab tiuxetan, Zevalin, Rituximab, Rituxan, Trastuzumab, Herceptin; monoclonal antibodies for the treatment of rheumatoid arthritis (RA) e.g. Adalimumab, Humira, Infliximab, Remicade; monoclonal antibodies for use as a radio-immuno-therapeutic e.g. Tositumomab and Iodine $I^{131}$, Tositumomab, Bexxar; drugs for the treatment of macular degeneration e.g. pegaptanib, Macugen; drugs for the treatment of malignancy e.g. Aldesleukin, Proleukin, Interleukin-2, Asparaginase, Elspar, Rasburicase, Elitek, Denileukin diftitox, Ontak, Pegaspargase, Oncaspar, goserelin, leuprolide; drugs for the treatment of multiple sclerosis (MS) e.g. Glatiramer acetate (e.g. copolymer-1), Copaxone, Interferon beta-1a, Avonex, Interferon beta-1a, Rebif, Interferon beta-1b, Betaseron; drugs for the treatment of mucositis e.g. palifermin, Kepivance; drug for the treatment of dystonia e.g., neurotoxin, Botulinum Toxin Type A, BOTOX, BOTOX Cosmetic, Botulinum Toxin Type B, MYOBLOC; drugs for the treatment of osteoporosis e.g. teriparatide, Forteo; drugs for the treatment of psoriasis e.g. Alefacept, Amevive; drugs for the treatment of RA e.g. abatacept, Orencia, Anakinra, Kineret, Etanercept, Enbrel; thrombolytics e.g. Alteplase, Activase, rtPA, Anistreplase, Eminase, Reteplase, Retavase, Streptokinase, Streptase, Tenecteplase, TNKase, Urokinase, Abbokinase, Kinlytic; drugs for the treatment of osteoporosis e.g. calcitonin (e.g. salmon), Miacalcin, Fortical, drugs for the treatment of skin ulcers e.g. Becaplermin, Regranex, Collagenase, Santyl.

Such polypeptides and chemical compounds may be referred to as diagnostic moieties, therapeutic moieties, prophylactic moieties or beneficial moieties.

Preferably the fusion partner and/or conjugation partner is not an albumin, variant or fragment thereof.

One or more (several) therapeutic or prophylactic polypeptides may be fused to the N-terminus, the C-terminus of albumin, inserted into a loop in the albumin structure or any combination thereof. It may or it may not comprise linker sequences separating the various components of the fusion polypeptide.

Teachings relating to fusions of albumin or a fragment thereof are known in the art and the skilled person will appreciate that such teachings can also be applied to the invention. WO 2001/79271A and WO 2003/59934 (incorporated herein by reference) also contain examples of therapeutic and prophylactic polypeptides that may be fused to albumin or fragments thereof, and these examples apply also to the invention.

The invention is further defined in the following embodiments:

1. A polypeptide which is a variant of albumin, fragment thereof or fusion polypeptide comprising said variant albumin or a fragment thereof having an altered binding affinity to FcRn compared with the binding affinity of a parent albumin, reference albumin, fragment thereof or fusion polypeptide comprising said parent albumin, reference albumin or fragment or fusion thereof to FcRn, wherein the polypeptide comprises alterations at two or more positions selected from positions corresponding to positions 492, 550, 573, 574 and 580 in SEQ ID NO: 2.

2. The polypeptide according to embodiment 1 wherein the polypeptide comprises alterations at two or more positions selected from positions corresponding to positions (a) 492 and 580; (b) 492 and 574; (c) 492 and 550; (d) 550 and 573; (e) 550 and 574; (f) 550 and 580 in SEQ ID NO: 2.

3. The polypeptide according to embodiment 1 or 2 comprising alterations at positions corresponding to positions 492 and 580 of SEQ ID NO: 1, further comprising one or more (several) alterations at positions corresponding to positions selected from the group consisting of 550, 573 and 574 of SEQ ID NO: 2.

4. The polypeptide according to embodiment 1, 2 or 3 comprising alterations at positions corresponding to positions 492 and 574 of SEQ ID NO: 1, further comprising one or more (several) alterations at positions corresponding to positions selected from the group consisting 550, 573 and 580 of SEQ ID NO:

5. The polypeptide according to any preceding embodiment comprising alterations at positions corresponding to positions 492 and 550 of SEQ ID NO: 1, further comprising one or more (several) alterations at positions corresponding to positions selected from the group consisting 573, 574 and 580 of SEQ ID NO: 2.

6. The polypeptide according to any preceding embodiment comprising alterations at positions corresponding to positions 550 and 573 of SEQ ID NO: 1, further comprising one or more (several) alterations at positions corresponding to positions selected from the group consisting 492, 574, and 580 of SEQ ID NO: 2.

7. The polypeptide according to any preceding embodiment comprising alterations at positions corresponding to positions 550 and 574 of SEQ ID NO: 1, further comprising one or more (several) alterations at positions corresponding to positions selected from the group consisting 492, 573 and 580 of SEQ ID NO: 2.

8. The polypeptide according to any preceding embodiment comprising alterations at positions corresponding to positions 550 and 580 of SEQ ID NO: 1, further comprising an alteration at a position corresponding to position 492, 573 and 574 of SEQ ID NO: 2.

9. The polypeptide according to any preceding embodiment in which:
(a) at a position corresponding to position 492 of SEQ ID NO: 2 there is an alteration to generate an amino acid from the group consisting of A, C, D, F, H, I, K, L, M, N, P, Q, R, S, T, V, W, Y, preferably D and at a position corresponding to position 573 of SEQ ID NO: 2 there is an alteration to generate an amino acid from the group consisting of C, D, E, F, G, H, I, L, M, N, Q, R, S, T, V, W, Y, preferably Y, W or H, or (b) at a position corresponding to position 492 of SEQ ID NO: 2 there is an alteration to generate G and at a position corresponding to position 573 there is an alteration to generate A or P and the polypeptide comprises an additional alteration at a position selected from the group consisting of 550, 574 and 580 (or equivalent positions of other albumins or variants or fragment thereof).

10. The polypeptide according to any preceding embodiment in which:

(a) at a position corresponding to position 573 of SEQ ID NO: 2 there is an alteration to generate an amino acid from the group consisting of A, C, D, E, F, G, H, I, L, M, N, Q, R, S, T, V, W, Y, preferably Y, W or H and at a position corresponding to position 574 of SEQ ID NO: 2 there is an alteration to generate an amino acid from the group consisting of A, C, D, E, F, G, H, I, L, M, P, Q, R, S, T, V, W, Y, H, D, F, G, N, S or Y, more preferably H, D, F or G, most preferably H, or (b) at a position corresponding to position 573 of SEQ ID NO: 2 there is a P and at a position corresponding to position 574 of SEQ ID NO: 2 there is an N and the polypeptide comprises an additional alteration at a position selected from the group consisting of 492, 550, and 580 (or equivalent positions of other albumins or variants or fragment thereof);

11. The polypeptide according to any preceding embodiment in which:

(a) at a position corresponding to position 573 of SEQ ID NO: 2 there is an alteration to generate an amino acid from the group consisting of A, C, D, E, F, G, H, I, L, M, N, Q, R, S, T, V, W, Y, preferably Y, W or H and at a position corresponding to position 580 of SEQ ID NO: 2 there is an alteration to generate an amino acid from the group consisting of C, D, E, F, G, H, I, L, M, N, P, R, S, T, V, W, Y, or (b) at a position corresponding to position 573 of SEQ ID NO: 2 there is an alteration to generate a P and at a position corresponding to position 580 of SEQ ID NO: 2 there is an alteration to generate a K and the polypeptide comprises an additional alteration at a position selected from the group consisting of 492, 550, and 574 (or equivalent positions of other albumins or variants or fragment thereof).

12. The polypeptide according to any preceding embodiment in which:

(a) at a position corresponding to position 574 of SEQ ID NO: 2 there is an alteration to generate an amino acid from the group consisting of A, C, D, E, F, G, H, I, L, M, P, Q, R, S, T, V, W, Y, H, D, F, G, N, S or Y, more preferably H, D, F or G, most preferably H and at a position corresponding to position 580 of SEQ ID NO: 2 there is an alteration to generate at a position corresponding to position to an amino acid from the group consisting of A, C, D, E, F, G, H, I, L, M, N, P, R, S, T, V, W, Y, or (b) at a position corresponding to position 574 of SEQ ID NO: 2 there is an alteration to generate an N and at a position corresponding to position 580 of SEQ ID NO: 2 there is an alteration to generate a K and the polypeptide comprises an additional alteration at a position selected from the group consisting of 492, 550, and 573 (or equivalent positions of other albumins or variants or fragment thereof).

13. The polypeptide according to any preceding embodiment, wherein the polypeptide comprises alterations at three or more positions selected from positions corresponding to positions 492, 550, 573, 574 and 580 in SEQ ID NO: 2.

14. The polypeptide according to any preceding embodiment wherein the alteration at the position corresponding to position 492, 550, 573, 574 and/or 580 is a substitution.

15. The polypeptide of embodiment 14 wherein the substitution at the position corresponding to position 492 is to G, D, F, H, M or R.

16. The polypeptide of embodiment 14 or 15 wherein the substitution at the position corresponding to position 492 is to G or D.

17. The polypeptide of any of embodiments 13 to 15 wherein the substitution at the position corresponding to position 492 is to G.

18. The polypeptide of any of embodiments 13 to 15 wherein the substitution at the position corresponding to position 492 is to D.

19. The polypeptide of any of embodiments 13 to 18 wherein the substitution at the position corresponding to position 550 is to K, L, M E, or R.

20. The polypeptide of any of embodiments 13 to 19 wherein the substitution at the position corresponding to position 550 is to K, L or M.

21. The polypeptide of any of embodiments 13 to 20 wherein the substitution at the position corresponding to position 550 is to K.

22. The polypeptide of any of embodiments 13 to 21 wherein the alteration at the position corresponding to position 573 is a substitution to P, Y, W, H, F, T, I or V.

23. The polypeptide of any of embodiments 13 to 22 wherein the substitution at the position corresponding to position 573 is to P, Y or W.

24. The polypeptide of any of embodiments 13 to 23 wherein the substitution at the position corresponding to position 573 is to a P.

25. The polypeptide of any of embodiments 13 to 24 wherein the alteration at the position corresponding to position 574 is a substitution to H, G, D, F, N, S or Y.

26. The polypeptide of any of embodiments 13 to 25 wherein the substitution at the position corresponding to position 574 is to D, F, G or H.

27. The polypeptide of any of embodiments 13 to 26 wherein the substitution at the position corresponding to position 574 is to H.

28. The polypeptide of any of embodiments 13 to 27 wherein the substitution at the position corresponding to position 580 is to K or R.

29. The polypeptide of any of embodiments 13 to 28 wherein the substitution at the position corresponding to position 580 is to K.

30. The polypeptide of any preceding embodiment wherein the polypeptide comprises alterations at positions corresponding to positions (i) 573 and 580; (ii) 492 and 573; or (iii) 573 and 574 of SEQ ID NO: 2.

31. The polypeptide of any preceding embodiment wherein the polypeptide comprises alterations at two or more positions corresponding to the following positions of SEQ ID NO: 2: 580K+573P (e.g. SEQ ID NO: 128); 580R+573P (e.g. SEQ ID NO: 129); 574D+573P (e.g. SEQ ID NO: 121); 574F+573P (e.g. SEQ ID NO: 122); 574G+573P (e.g. SEQ ID NO: 123); 574H+573P (e.g. SEQ ID NO: 124); 574N+573P (e.g. SEQ ID NO: 125); 574S+573P (e.g. SEQ ID NO: 126); 550K+580K (e.g. SEQ ID NO: 132); 550K+574H (e.g. SEQ ID NO: 130); 550K+573P (e.g. SEQ ID NO: 117); 492D+573P (e.g. SEQ ID NO: 108); 492F+573P (e.g. SEQ ID NO: 109); 492H+573P (e.g. SEQ ID NO: 111); 492R+573P (e.g. SEQ ID NO: 112); 574H+580K (e.g.

SEQ ID NO: 134); 550L+574H (e.g. SEQ ID NO: 245); 550L+580K (e.g. SEQ ID NO: 247); 550M+580K (e.g. SEQ ID NO: 251); 492D+550K (e.g. SEQ ID NO: 231); 550M+574H (e.g. SEQ ID NO: 249); 492D+574H (e.g. SEQ ID NO: 232); 492G+550K (e.g. SEQ ID NO: 240); 550M+574H (e.g. SEQ ID NO: 249); or 492G+574H (e.g. SEQ ID NO: 241).

32. The polypeptide according to any preceding embodiment wherein the polypeptide comprises three or more alterations at positions selected from the group consisting of positions corresponding to the following positions of SEQ ID NO: 2: 492, 550, 573, 574 and 580.

33. The polypeptide of embodiment 32 wherein the polypeptide comprises alterations at positions corresponding to the following positions of SEQ ID NO: 2: 574H+580K+573P (e.g. SEQ ID NO: 135); 550K+574H+573P (e.g. SEQ ID NO: 131); 492D+550K+573P (e.g. SEQ ID NO: 253); 550M+573P+580K (e.g. SEQ ID NO: 252); 550L+573P+580K (e.g. SEQ ID NO: 253); 492G+573P+580K (e.g. SEQ ID NO: 242); 550M+573P+574H (e.g. SEQ ID NO: 250); 492G+550K+573P (e.g. SEQ ID NO: 254); 550L+573P+574H (e.g. SEQ ID NO: 246); 492D+573P+580K (e.g. SEQ ID NO: 234); 492D+573P+574H (e.g. SEQ ID NO: 233); 492G+574H+580K (e.g. SEQ ID NO: 263); 492G+550K+580K (e.g. SEQ ID NO: 259); 492D+550K+580K (e.g. SEQ ID NO: 258); 492D+574H+580K (e.g. SEQ ID NO: 262); or 492G+550K+574H (e.g. SEQ ID NO: 255).

34. The polypeptide according to any preceding embodiment wherein the polypeptide comprises four or more alterations at positions selected from the group consisting of positions corresponding to the following positions of SEQ ID NO: 2: 492, 550, 573, 574 and 580.

35. The polypeptide of embodiment 34 wherein the polypeptide comprises alterations at positions corresponding to the following positions of SEQ ID NO: 2: 492G+573P+574H+580K (e.g. SEQ ID NO: 115); 492D+573P+574H+580K (e.g. SEQ ID NO: 114); 550K+573P+574H+580K (e.g. SEQ ID NO: 265); 492G+550K+573P+580K (e.g. SEQ ID NO: 261); 492F+573P+574H+580K (e.g. SEQ ID NO: 237); 492G+573P+574G+580K (e.g. SEQ ID NO: 243); 492D+573P+574H+580R (e.g. SEQ ID NO: 236); 492G+573P+574H+580R (e.g. SEQ ID NO: 244); 492D+550K+573P+580K (e.g. SEQ ID NO: 260); 492D+550K+573P+574H (e.g. SEQ ID NO: 256); 492F+573P+574H+580R (e.g. SEQ ID NO: 239); 492D+573P+574G+580K (e.g. SEQ ID NO: 235); or 492F+573P+574G+580K (e.g. SEQ ID NO: 238);

36. The polypeptide according to any preceding embodiment wherein the polypeptide comprises five or more alterations at positions selected from the group consisting of positions corresponding to the following positions of SEQ ID NO: 2: 492, 550, 573, 574 and 580.

37. The polypeptide according to embodiment wherein the polypeptide comprises alterations at positions corresponding to the following positions of SEQ ID NO: 2: 492G+550K+573P+574H+580K (e.g. SEQ ID NO: 267) or 492D+550K+573P+574H+580K (e.g. SEQ ID NO: 266).

38. The polypeptide according to any preceding embodiment comprising alterations corresponding to the following positions in SEQ ID NO: 2: 492G+573P+574H+580K (e.g. SEQ ID NO: 115); 492G+550K+573P+574H (e.g. SEQ ID NO: 257); 492D+550K+573P+574H (e.g. SEQ ID NO: 256); 492G+550K+573P (e.g. SEQ ID NO: 254); 492D+550K+573P (e.g. SEQ ID NO: 253); 550M+573P+580K (e.g. SEQ ID NO: 252); 550L+573P+580K (e.g. SEQ ID NO: 248); 550L+573P+574H (e.g. SEQ ID NO: 246); 492G+573P+580K (e.g. SEQ ID NO: 242); 492D+573P+580K (e.g. SEQ ID NO: 234); 573P+574H+580K (e.g. SEQ ID NO: 135); 550K+573P+580K (e.g. SEQ ID NO: 133); 550K+573P+574H (e.g. SEQ ID NO: 131); or 492D+573P+574H+580K (SEQ ID NO: 114).

39. The polypeptide of any of embodiments 1 to 38 wherein the reference albumin is HSA (SEQ ID No: 2) or a fragment thereof, or a fusion polypeptide comprising HSA or a fragment thereof, most preferably SEQ ID NO: 2.

40. The polypeptide according to any of embodiments 1 to 39, having a stronger binding affinity to FcRn and/or longer plasma half-life than a parent albumin, reference albumin, fragment thereof or fusion polypeptide comprising said parent albumin, reference albumin or fragment or fusion thereof.

41. The polypeptide according any of embodiments 1 to 40, wherein the sequence identity of the polypeptide to SEQ ID NO: 2 is more than 80%, preferably more than 90%, more preferred more than 95%, more preferred more than 96%, even more preferred more than 97%, more preferred more than 98% and most preferred more than 99%.

42. A fusion polypeptide comprising a polypeptide according to any of embodiments 1 to 41 and a fusion partner polypeptide selected from a therapeutic, prophylactic, diagnostic, imaging or other beneficial moiety.

43. A method for preparing a polypeptide which is a variant of albumin, fragment thereof or fusion polypeptide comprising said variant albumin or fragment thereof having a binding affinity to FcRn which is altered compared to the binding affinity of a reference albumin, fragment or fusion thereof to FcRn, comprising:
  (a) Providing a nucleic acid encoding a parent albumin having at least 80% sequence identity to SEQ ID NO: 2;
  (b) Modifying the sequence of step (a), to encode a polypeptide which is a variant albumin, fragment thereof or fusion polypeptide comprising said variant albumin or fragment thereof comprising alterations at two or more positions corresponding to positions selected from 492, 550, 573, 574 and 580 in SEQ ID NO: 2, preferably as described in any of embodiments 1 to 13;
  (c) Introducing the modified sequence of step (b) in a suitable host cell;
  (d) Growing the cells in a suitable growth medium under condition leading to expression of the polypeptide; and
  (e) Recovering the polypeptide from the growth medium; wherein the polypeptide has an altered binding affinity to FcRn and/or an altered plasma half-life compared with the half-life of a parent albumin, reference albumin, fragment thereof or fusion polypeptide comprising said parent albumin, reference albumin or fragment or fusion thereof.

44. The method of embodiment 43 wherein the substitution at the position corresponding to position 492 is a substitution to G, D, F, H, M or R, preferably G or D 45. The method of embodiment 44 wherein the substitution at the position corresponding to position 492 is to G.

46. The method of embodiment 44 wherein the substitution at the position corresponding to position 492 is to D.

47. The method of any of embodiments 43 to 46 wherein the substitution at the position corresponding to position 550 is to K, L, M, E or R, preferably K, L or M, most preferably K.

48. The method of any of embodiments 43 to 47 wherein the substitution at the position corresponding to position 573 is a substitution to P, Y, W, H, F, T, I or V, preferably P, Y, or W, most preferably P.

49. The method of any of embodiments 43 to 48 wherein the substitution at the position corresponding to position 574 is a substitution to H, D, F, G, N, S or Y, preferably H, D, F,or G, most preferably H.

50. The method of any of embodiments any of embodiments 43 to 49 wherein the substitution at the position corresponding to position 580 is a substitution to K or R, most preferably R.

51. The method of any of embodiments 43 to 50 wherein the two or more alterations are at positions corresponding to positions (i) 573 and 580; (ii) 492 and 573; or (iii) 573 and 574 of SEQ ID NO: 2.

52. The method according to any of embodiments 43 to 51 wherein the two or more alterations are at positions corresponding to the following positions of SEQ ID NO: 2: 580K+573P (e.g. SEQ ID NO: 128); 580R+573P (e.g. SEQ ID NO: 129); 574D+573P (e.g. SEQ ID NO: 121); 574F+573P (e.g. SEQ ID NO: 122); 574G+573P (e.g. SEQ ID NO: 123); 574H+573P (e.g. SEQ ID NO: 124); 574N+573P (e.g. SEQ ID NO: 125); 574S+573P (e.g. SEQ ID NO: 126); 550K+580K (e.g. SEQ ID NO: 132); 550K+574H (e.g. SEQ ID NO: 130); 550K+573P (e.g. SEQ ID NO: 117); 492D+573P (e.g. SEQ ID NO: 108); 492F+573P (e.g. SEQ ID NO: 109); 492H+573P (e.g. SEQ ID NO: 111); 492R+573P (e.g. SEQ ID NO: 112); 574H+580K (e.g. SEQ ID NO: 134); 550L+574H (e.g. SEQ ID NO: 245); 550L+580K (e.g. SEQ ID NO: 247); 550M+580K (e.g. SEQ ID NO: 251); 492D+550K (e.g. SEQ ID NO: 231); 550M+574H (e.g. SEQ ID NO: 249); 492D+574H (e.g. SEQ ID NO: 232); 492G+550K (e.g. SEQ ID NO: 240); 550M+574H (e.g. SEQ ID NO: 249); or 492G+574H (e.g. SEQ ID NO: 241).

53. The method according to any of embodiments 43 to 52 comprising three or more alterations at positions selected from the group consisting of positions corresponding to the following positions of SEQ ID NO: 2: 492, 550, 573, 574 and 580.

54. The method according to any of embodiments 43 to 53 comprising alterations at positions corresponding to the following positions of SEQ ID NO: 2: 574H+580K+573P (e.g. SEQ ID NO: 135); 550K+574H+573P (e.g. SEQ ID NO: 131); 492D+550K+573P (e.g. SEQ ID NO: 253); 550M+573P+580K (e.g. SEQ ID NO: 252); 550L+573P+580K (e.g. SEQ ID NO: 253); 492G+573P+580K (e.g. SEQ ID NO: 242); 550M+573P+574H (e.g. SEQ ID NO: 250); 492G+550K+573P (e.g. SEQ ID NO: 254); 550L+573P+574H (e.g. SEQ ID NO: 246); 492D+573P+580K (e.g. SEQ ID NO: 234); 492D+573P+574H (e.g. SEQ ID NO: 233); 492G+574H+580K (e.g. SEQ ID NO: 263); 492G+550K+580K (e.g. SEQ ID NO: 259); 492D+550K+580K (e.g. SEQ ID NO: 258); 492D+574H+580K (e.g. SEQ ID NO: 262); or 492G+550K+574H (e.g. SEQ ID NO: 255).

55. The method according to any of embodiments 43 to 54 comprising four or more alterations at positions selected from the group consisting of positions corresponding to the following positions of SEQ ID NO: 2: 492, 550, 573, 574 and 580.

56. The method according to any of embodiments 43 to 55 comprising alterations at positions corresponding to the following positions of SEQ ID NO: 2: 492G+573P+574H+580K (e.g. SEQ ID NO: 115); 492D+573P+574H+580K (e.g. SEQ ID NO: 114); 550K+573P+574H+580K (e.g. SEQ ID NO: 265); 492G+550K+573P+580K (e.g. SEQ ID NO: 261); 492F+573P+574H+580K (e.g. SEQ ID NO: 237); 492G+573P+574G+580K (e.g. SEQ ID NO: 243); 492D+573P+574H+580R (e.g. SEQ ID NO: 236); 492G+573P+574H+580R (e.g. SEQ ID NO: 244); 492D+550K+573P+580K (e.g. SEQ ID NO: 260); 492D+550K+573P+574H (e.g. SEQ ID NO: 256); 492F+573P+574H+580R (e.g. SEQ ID NO: 239); 492D+573P+574G+580K (e.g. SEQ ID NO: 235); or 492F+573P+574G+580K (e.g. SEQ ID NO: 238);

57. The method according to any of embodiments 43 to 56 comprising five or more alterations at positions selected from the group consisting of positions corresponding to the following positions of SEQ ID NO: 2: 492, 550, 573, 574 and 580.

58. The polypeptide according to any of embodiments 43 to 57 comprising alterations at positions corresponding to the following positions of SEQ ID NO: 2: 492G+550K+573P+574H+580K (e.g. SEQ ID NO: 267) or 492D+550K+573P+574H+580K (e.g. SEQ ID NO: 266).

59. The method according to any of embodiments 43 to 58 comprising alterations at positions corresponding to the following positions in SEQ ID NO: 2: 492G+573P+574H+580K (e.g. SEQ ID NO: 115); 492G+550K+573P+574H (e.g. SEQ ID NO: 257); 492D+550K+573P+574H (e.g. SEQ ID NO: 256); 492G+550K+573P (e.g. SEQ ID NO: 254); 492D+550K+573P (e.g. SEQ ID NO: 253); 550M+573P+580K (e.g. SEQ ID NO: 252); 550L+573P+580K (e.g. SEQ ID NO: 248); 550L+573P+574H (e.g. SEQ ID NO: 246); 492G+573P+580K (e.g. SEQ ID NO: 242); 492D+573P+580K (e.g. SEQ ID NO: 234); 573P+574H+580K (e.g. SEQ ID NO: 135); 550K+573P+580K (e.g. SEQ ID NO: 133); 550K+573P+574H (e.g. SEQ ID NO: 131); or 492D+573P+574H+580K (SEQ ID NO: 114).

60. The method any of embodiments 43 to 59 wherein the reference albumin is HSA (SEQ ID No: 2) or a fragment thereof, or a fusion polypeptide comprising HSA or a fragment thereof, most preferably SEQ ID NO: 2.

61. The method according any of embodiments 43 to 60, wherein the sequence identity of the polypeptide to SEQ ID NO: 2 is more than 80%, preferably more than 90%, more preferred more than 95%, more preferred more than 96%, even more preferred more than 97%, more preferred more than 98% and most preferred more than 99%.

62. A conjugate comprising a polypeptide according to any of embodiments 1 to 42 or obtainable by a method according to any of embodiments 43 to 61 and a conjugation partner.

63. The conjugate according to embodiment 62 wherein the conjugation partner is a therapeutic, prophylactic, diagnostic, imaging or other beneficial moiety.

64. An associate comprising a polypeptide according to any of embodiments 1 to 42 or obtainable by a method according to any of embodiments 43 to 61 and a therapeutic, prophylactic, diagnostic, imaging or other beneficial moiety.

65. A nanoparticle or microparticle comprising a polypeptide according to any of embodiments 1 to 42 or obtainable by a method according to any of embodiments 43 to 61, a conjugate according to embodiment 62 or 63 or an associate according to embodiment 64.

66. A composition comprising a polypeptide according to any of embodiments 1 to 42 or obtainable by a method according to any of embodiments 43 to 61, a conjugate according to embodiment 62 or 63, an associate according to embodiment 64 or a nanoparticle or microparticle according embodiment 65, wherein the binding affinity of the polypeptide, fusion polypeptide, conjugate, associate or nanoparticle or microparticle to FcRn is stronger than the binding affinity of a composition comprising the corresponding parent albumin, reference albumin, fragment thereof or fusion polypeptide, conjugate, associate or nanoparticle or microparticle comprising said parent albumin, reference albumin or fragment or fusion thereof to FcRn.

67. A composition according to embodiment 66 where the binding affinity of the polypeptide, fusion polypeptide, conjugate, associate or nanoparticle or microparticle to FcRn is stronger than the binding affinity of HSA to FcRn.

68. A composition according to embodiment 66 or 67, wherein the binding coefficient of the variant of the polypeptide, fusion polypeptide, conjugate, associate or nanoparticle or microparticle to FcRn is less than 0.9× KD of HSA to FcRn, more preferred less than 0.5× KD of HSA to FcRn, more preferred less than 0.1× KD of HSA to FcRn, even more preferred less than 0.05× KD of HSA to FcRn, even more preferred less than 0.02× KD of HSA to FcRn and most preferred less than 0.01× KD of HSA to FcRn.

69. The composition according to any of embodiments 66 to 68, comprising a polypeptide according to any of embodiments 1 to 42 or obtainable by a method according to any of embodiments 43 to 61, a conjugate according to embodiment 62 or 63, an associate according to embodiment 64 or a nanoparticle or microparticle according embodiment 65, further comprising a compound comprising an antibody binding domain (ABD) and a therapeutic, prophylactic, diagnostic, imaging or other beneficial moiety.

70. The composition according to any of embodiments 66 to 69, comprising a pharmaceutically acceptable carrier or excipient.

71. Use of a polypeptide according to any of embodiments 1 to 42 or obtainable by a method according to any of embodiments 43 to 61, a conjugate according to embodiment 62 or 63, an associate according to embodiment 64 or a nanoparticle or microparticle according embodiment 65 or a composition according to any of embodiments 66 to 70 to alter the binding affinity to FcRn or half-life, preferably in plasma, of a therapeutic, prophylactic, diagnostic, imaging or other beneficial moiety.

72. The use according to embodiment 71 wherein the binding affinity to FcRn is increased relative to the binding affinity of a reference comprising or consisting of HSA (SEQ ID NO: 2) or a fragment, fusion, conjugate, associate, nanoparticle or microparticle thereof to FcRn.

73. The use according to embodiment 71 wherein the binding affinity to FcRn is decreased relative to the binding affinity of a reference comprising or consisting of HSA (SEQ ID NO: 2) or a fragment, fusion, conjugate, associate, nanoparticle or microparticle thereof to FcRn.

74. A method for altering the binding affinity to FcRn or half-life preferably in plasma, of a molecule comprising:
  (a) where the molecule is a polypeptide, fusing or conjugating the molecule to a polypeptide according to any of embodiments 1 to 42 or obtainable by a method of embodiments 43 to 61, or to a conjugate according to embodiment 62 or 63; associating the molecule to a polypeptide according to any of embodiments 1 to 42 or obtainable by a method of embodiments 43 to 61 or to a conjugate according to embodiment 62 or 63; incorporating the molecule in an associate according to embodiment 64, in nanoparticle or microparticle according to embodiment 65 or a composition according to any of embodiments 66 to 70;
  (b) where the molecule is not a polypeptide, conjugating the molecule to a polypeptide according to any of embodiments 1 to 42 or obtainable by a method of embodiments 43 to 61, or to a conjugate according to embodiment 62 or 63; associating the molecule to a polypeptide according to any of embodiments 1 to 42 or obtainable by a method of embodiments 43 to 61 or to a conjugate according to embodiment 62 or 63; incorporating the molecule in an associate according to embodiment 64, in nanoparticle or microparticle according to embodiment 65 or a composition according to any of embodiments 66 to 70.

75. A method according to embodiment 74 wherein the molecule is a therapeutic, prophylactic, diagnostic, imaging or other beneficial moiety.

76. A polypeptide, fusion polypeptide, conjugate, associate, nanoparticle or microparticle or composition thereof according to any of embodiments 1 to 42 or 62 to 70 or obtainable by the method of embodiments 43 to 61 wherein the polypeptide, fusion polypeptide, conjugate, associate, nanoparticle or microparticle or composition comprises one or more (several) moiety selected from those described herein.

77. A nucleic acid encoding the polypeptide or fusion polypeptide of any of embodiments 1 to 76.

78. A vector comprising a nucleic acid according to embodiment 77.

79. A host cell comprising a nucleic acid according to embodiment 77 or a vector according to embodiment 78.

80. A host cell according to embodiment 79 wherein the host cell is a eukaryote, preferably a yeast (such as *Saccharomyces cerevisiae*) or a mammalian cell (such as CHO or HEK) or a plant cell (such as rice).

81. A method of prophylaxis, treatment or diagnosis comprising administering a polypeptide, fusion polypeptide, conjugate, composition, associate, nanoparticle or microparticle or polynucleotide according to any of embodiments 1 to 42 or 62 to 70 or obtainable by the method of any of embodiments 43 to 61 to a subject.

The invention is further described by the following examples that should not be construed as limiting the scope of the invention.

EXAMPLES

Example 1. Preparation of HSA Variant Expression Plasmids for HSA

HSA variants were expressed using standard molecular biology techniques, such as described in Sambrook, J. and D. W. Russell, 2001 (Molecular Cloning: a laboratory manual, 3$^{rd}$ ed. Cold Spring Harbor Laboratory Press, Cold Spring Harbor, N.Y).

Method 1:

Permutation libraries at positions E492, D550, K574H and Q580K were produced by PCR amplification of pDB4081, encoding wild type HSA (described below), using a mutagenic forward primer and non-mutagenic reverse primer as shown in Table 2. The PCR conditions are shown in Tables 3 and 4. 2 µl of reaction product was assessed by agarose gel electrophoresis and the remainder treated with 5 µl of 10× buffer 4 (New England Biolabs −50 mM potassium acetate, 20 mM Tris-acetate, 10 mM magnesium acetate, 1 mM DTT pH 7.9 at 25° C.) and 1 µl DpnI (NEB) for 1 hour at 37° C. The reactions were purified by addition of 50 µl water, prior to application of a vacuum for 20 minutes. A further 50 µl of water was added and a vacuum applied until the well was dry. Plasmid DNA was recovered by addition of 30 µl of water and incubation for 1 minute. 2 µl of this purified product was transformed into 15 µl TOP10 *E. coli* cells by standard protocols. Clones were selected and grown overnight in LB supplemented with 100 µg/ml ampicillin and purified using a Qiagen QIAprep 96 miniprep kit according to manufacturer's instructions. Variants were verified by sequencing.

pDB4081 was made by the ligation of a synthetic DNA fragment, BsaI/SphI digested, which had been generated by gene assembly (DNA2.0 Inc, USA), containing 3' region of the PRB1 promoter, modified fusion leader sequence, nucleotide sequence encoding HSA and 5' region of the modified ADH1 terminator) into HindIII/SphI-digested pDB4005. pDB4005 is described in WO 2011/051489 (incorporated herein by reference).

TABLE 2

Plasmid and amino acid substitution and relevant primers

| Variant | Variant SEQ ID No. | Oligo1 (SEQ ID No.) | Oligo 2 (SEQ ID No.) | Plasmid name |
|---|---|---|---|---|
| HSA E492A | 32 | HSA-1 (136) | REV E492 (212) | pDB4768 |
| HSA E492C | 33 | HSA-2 (137) | REV E492 (212) | pDB4769 |
| HSA E492D | 34 | HSA-3 (138) | REV E492 (212) | pDB4770 |
| HSA E492F | 35 | HSA-4 (139) | REV E492 (212) | pDB4771 |
| HSA E492G | 36 | HSA-5 (140) | REV E492 (212) | pDB4772 |
| HSA E492H | 37 | HSA-6 (141) | REV E492 (212) | pDB4773 |
| HSA E492I | 38 | HSA-7 (142) | REV E492 (212) | pDB4774 |
| HSA E492K | 39 | HSA-8 (143) | REV E492 (212) | pDB4775 |
| HSA E492L | 40 | HSA-9 (144) | REV E492 (212) | pDB4776 |
| HSA E492M | 41 | HSA-10 (145) | REV E492 (212) | pDB4777 |
| HSA E492N | 42 | HSA-11 (146) | REV E492 (212) | pDB4778 |
| HSA E492P | 43 | HSA-12 (147) | REV E492 (212) | pDB4779 |
| HSA E492Q | 44 | HSA-13 (148) | REV E492 (212) | pDB4780 |
| HSA E492R | 45 | HSA-14 (149) | REV E492 (212) | pDB4781 |
| HSA E492S | 46 | HSA-15 (150) | REV E492 (212) | pDB4782 |
| HSA E492T | 47 | HSA-16 (151) | REV E492 (212) | pDB4783 |
| HSA E492V | 48 | HSA-17 (152) | REV E492 (212) | pDB4784 |
| HSA E492W | 49 | HSA-18 (153) | REV E492 (212) | pDB4785 |
| HSA E492Y | 50 | HSA-19 (154) | REV E492 (212) | pDB4856 |
| HSA D550A | 51 | HSA-20 (155) | REV D550 (213) | pDB4786 |
| HSA D550C | 52 | HSA-21 (156) | REV D550 (213) | pDB4857 |
| HSA D550E | 53 | HSA-22 (157) | REV D550 (213) | pDB4858 |
| HSA D550F | 54 | HSA-23 (158) | REV D550 (213) | pDB4859 |
| HSA D550G | 55 | HSA-24 (159) | REV D550 (213) | pDB4787 |
| HSA D550H | 56 | HSA-25 (160) | REV D550 (213) | pDB4788 |
| HSA D550I | 57 | HSA-26 (161) | REV D550 (213) | pDB4789 |
| HSA D550K | 58 | HSA-27 (162) | REV D550 (213) | pDB4790 |
| HSA D550L | 59 | HSA-28 (163) | REV D550 (213) | pDB4791 |
| HSA D550M | 60 | HSA-29 (164) | REV D550 (213) | pDB4792 |
| HSA D550N | 61 | HSA-30 (165) | REV D550 (213) | pDB4793 |
| HSA D550P | 62 | HSA-31 (166) | REV D550 (213) | pDB4794 |
| HSA D550Q | 63 | HSA-32 (167) | REV D550 (213) | pDB4795 |
| HSA D550R | 64 | HSA-33 (168) | REV D550 (213) | pDB4796 |
| HSA D550S | 65 | HSA-34 (169) | REV D550 (213) | pDB4797 |
| HSA D550T | 66 | HSA-35 (170) | REV D550 (213) | pDB4798 |
| HSA D550V | 67 | HSA-36 (171) | REV D550 (213) | pDB4799 |
| HSA D550Y | 68 | HSA-37 (172) | REV D550 (213) | pDB4800 |
| HSA D550W | 69 | HSA-38 (173) | REV D550 (213) | pDB4801 |
| HSA K574A | 70 | HSA-39 (174) | REV K574 (214) | pDB4802 |
| HSA K574C | 71 | HSA-40 (175) | REV K574 (214) | pDB4803 |
| HSA K574D | 72 | HSA-41 (176) | REV K574 (214) | pDB4804 |
| HSA K574E | 73 | HSA-42 (177) | REV K574 (214) | pDB4805 |
| HSA K574F | 74 | HSA-43 (178) | REV K574 (214) | pDB4806 |
| HSA K574G | 75 | HSA-44 (179) | REV K574 (214) | pDB4807 |
| HSA K574H | 76 | HSA-45 (180) | REV K574 (214) | pDB4808 |
| HSA K574I | 77 | HSA-46 (181) | REV K574 (214) | pDB4809 |
| HSA K574L | 78 | HSA-47 (182) | REV K574 (214) | pDB4810 |
| HSA K574M | 79 | HSA-48 (183) | REV K574 (214) | pDB4811 |
| HSA K574N | 80 | HSA-49 (184) | REV K574 (214) | pDB4812 |
| HSA K574P | 81 | HSA-50 (185) | REV K574 (214) | pDB4813 |
| HSA K574Q | 82 | HSA-51 (186) | REV K574 (214) | pDB4814 |
| HSA K574R | 83 | HSA-52 (187) | REV K574 (214) | pDB4815 |
| HSA K574S | 84 | HSA-53 (188) | REV K574 (214) | pDB4816 |
| HSA K574T | 85 | HSA-54 (189) | REV K574 (214) | pDB4817 |
| HSA K574V | 86 | HSA-55 (190) | REV K574 (214) | pDB4818 |
| HSA K574Y | 87 | HSA-56 (191) | REV K574 (214) | pDB4819 |
| HSA K574W | 88 | HSA-57 (192) | REV K574 (214) | pDB4820 |
| HSA Q580A | 89 | HSA-58 (193) | REV Q580 (215) | pDB4821 |
| HSA Q580C | 90 | HSA-59 (194) | REV Q580 (215) | pDB4822 |
| HSA Q580D | 91 | HSA-60 (195) | REV Q580 (215) | pDB4823 |
| HSA Q580E | 92 | HSA-61 (196) | REV Q580 (215) | pDB4824 |
| HSA Q580F | 93 | HSA-62 (197) | REV Q580 (215) | pDB4825 |
| HSA Q580G | 94 | HSA-63 (198) | REV Q580 (215) | pDB4826 |
| HSA Q580H | 95 | HSA-64 (199) | REV Q580 (215) | pDB4827 |
| HSA Q580I | 96 | HSA-65 (200) | REV Q580 (215) | pDB4828 |
| HSA Q580K | 97 | HSA-66 (201) | REV Q580 (215) | pDB4829 |
| HSA Q580L | 98 | HSA-67 (202) | REV Q580 (215) | pDB4830 |
| HSA Q580M | 99 | HSA-68 (203) | REV Q580 (215) | pDB4831 |
| HSA Q580N | 100 | HSA-69 (204) | REV Q580 (215) | pDB4832 |
| HSA Q580P | 101 | HSA-70 (205) | REV Q580 (215) | pDB4833 |
| HSA Q580R | 102 | HSA-71 (206) | REV Q580 (215) | pDB4834 |
| HSA Q580S | 103 | HSA-72 (207) | REV Q580 (215) | pDB4835 |
| HSA Q580T | 104 | HSA-73 (208) | REV Q580 (215) | pDB4836 |
| HSA Q580V | 105 | HSA-74 (209) | REV Q580 (215) | pDB4837 |
| HSA Q580Y | 106 | HSA-75 (210) | REV Q580 (215) | pDB4838 |
| HSA Q580W | 107 | HSA-76 (211) | REV Q580 (215) | pDB4839 |

TABLE 3

PCR reaction components

| *HF buffer (5x) | 10 µl | template DNA (20 ng/µl) | 1 µl |
|---|---|---|---|
| dNTP (2.5 mM) | 5 µl | *Phusion (polymerase) | 0.5 µl |
| oligo 1 (20 µM) | 1 µl | dH₂O | 31.5 µl |
| oligo 2 (20 µM) | 1 µl | | |

(*HF buffer and Phusion polymerase are from New England Biolabs)

TABLE 4

PCR reaction conditions

| Temperature | Cycle length | Number of cycles |
|---|---|---|
| 98° C. | 3 min | 1 |
| 98° C. | 15 sec | 30 |
| 65° C. | 35 sec | |
| 72° C. | 11 min | |
| 72° C. | 11 min | 1 |

Method 2:

Variants described in Table 5 and 6 were produced as described in WO2012/150319, Example 6, Method 2 'Production of combination Variants with K573P' (incorporated herein by reference), with the following modifications. For variants shown in Table 5, a fragment encoding the K573P mutation was removed from pDB4673 via the SalI and Bsu36I restriction sites and inserted into similarly digested parent plasmid, as indicated in Table 5. pDB4673 (HSA K573P) was constructed by insertion of the fragment produced by digestion of pD4283 (described in WO 2011/051489, incorporated herein by reference) with SalI and HinDIII restriction enzymes into similarly digested pDB4081. For variants shown in Table 6, the fragment encoding K573P+K574H+Q580K was removed from pDB5032 using the SalI and Bsu36I restriction sites and inserted into similarly digested parent plasmid, as indicated in Table 6.

TABLE 5

Plasmid and amino acid substitution

| Variant | Variant SEQ ID No. | Relevant Parent Plasmid | Plasmid name |
|---|---|---|---|
| HSA E492D + K573P | 108 | pDB4770 | pDB4990 |
| HSA E492F + K573P | 109 | pDB4771 | pDB4991 |
| HSA E492G + K573P | 110 | pDB4772 | pDB4992 |
| HSA E492H + K573P | 111 | pDB4773 | pDB4993 |
| HSA E492M + K573P | 112 | pDB4777 | pDB4994 |
| HSA E492R + K573P | 113 | pDB4781 | pDB4995 |

TABLE 6

Plasmid and amino acid substitution

| Variant | Variant SEQ ID No. | Relevant Parent Plasmid | Plasmid name |
|---|---|---|---|
| HSA E492D + K573P + K574H + Q580K | 114 | pDB4770 | pDB5091 |
| HSA E492G + K573P + K574H + Q580K | 115 | pDB4772 | pDB5092 |

Method 3:

Variants described in Table 7 were produced as described in WO2012/150319, Example 6, Method 1 (incorporated herein by reference), using the plasmids indicated in the tables as templates for the PCR reactions. The conditions described in Tables 8 and 9 were used to produce pDB4997-5004, pDB 5042-46, and pDB5030-1. Those described in Tables 10 and 11 were used to produce pDB5027-29 and pDB5032. The mutated PCR products were digested using SalI and Bsu36I restriction enzymes and inserted into similarly digested pDB4081, encoding wild type HSA (as described above).

TABLE 7

Plasmid and amino acid substitution and relevant primers

| Variant | Variant SEQ ID No. | Oligo 1 (SEQ ID No.) | Oligo 2 (SEQ ID No.) | Template plasmid | Plasmid Name |
|---|---|---|---|---|---|
| HSA D550E + K573P | 116 | KBf4 (216) | KBr30 (217) | pDB4858 | pDB5042 |
| HSA D550K + K573P | 117 | KBf4 (216) | KBr30 (217) | pDB4790 | pDB5043 |
| HSA D550L + K573P | 118 | KBf4 (216) | KBr30 (217) | pDB4791 | pDB5044 |
| HSA D550M + K573P | 119 | KBf4 (216) | KBr30 (217) | pDB4792 | pDB5045 |
| HSA D550R + K573P | 120 | KBf4 (216) | KBr30 (217) | pDB4796 | pDB5046 |
| HSA K574D + K573P | 121 | KBf4 (216) | KBr21 (218) | pDB4673 | pDB4997 |
| HSA K574F + K573P | 122 | KBf4 (216) | KBr22 (219) | pDB4673 | pDB4998 |
| HSA K574G + K573P | 123 | KBf4 (216) | KBr23 (220) | pDB4673 | pDB4999 |
| HSA K574H + K573P | 124 | KBf4 (216) | KBr24 (221) | pDB4673 | pDB5000 |
| HSA K574N + K573P | 125 | KBf4 (216) | KBr25 (222) | pDB4673 | pDB5001 |
| HSA K574S + K573P | 126 | KBf4 (216) | KBr26 (223) | pDB4673 | pDB5002 |
| HSA K574Y + K573P | 127 | KBf4 (216) | KBr27 (224) | pDB4673 | pDB5005 |
| HSA Q580K + K573P | 128 | KBf4 (216) | KBr28 (225) | pDB4673 | pDB5003 |
| HSA Q580R + K573P | 129 | KBf4 (216) | KBr29 (226) | pDB4673 | pDB5004 |
| HSA D550K + K574H | 130 | KBf4 (216) | KBr31 (227) | pDB4790 | pDB5027 |
| HSA D550K + K574H + K573P | 131 | KBf4 (216) | KBr24 (221) | pDB4790 | pDB5028 |
| HSA D550K + Q580K | 132 | KBf4 (216) | KBr32 (228) | pDB4790 | pDB5029 |
| HSA D550K + Q580K + K573P | 133 | KBf4 (216) | KBr28 (225) | pDB5043 | pDB5030 |
| HSA K574H + Q580K | 134 | KBf4 (216) | KBr33 (229) | pDB4808 | pDB5031 |
| HSA K574H + Q580K + K573P | 135 | KBf4 (216) | KBr34 (230) | pDB5003 | pDB5032 |

TABLE 8

PCR reaction components

| | | | |
|---|---|---|---|
| HF buffer (5×) | 10 µl | template DNA (5 ng/µl) | 1 µl |
| dNTP (10 mM) | 1 µl | Phusion (polymerase) | 0.5 µl |
| oligo 1 (10 µM) | 1 µl | dH$_2$O | 35.5 µl |
| oligo 2 (10 µM) | 1 µl | | |

TABLE 9

PCR reaction conditions

| Temperature | Cycle length | Number of cycles |
|---|---|---|
| 98° C. | 2 min | 1 |
| 98° C. | 10 sec | 35 |
| 61° C. | 20 sec | |
| 72° C. | 30 sec | |
| 72° C. | 7 min | 1 |

TABLE 10

PCR reaction components

| | | | |
|---|---|---|---|
| HF buffer (5×) | 20 µl | template DNA (5 ng/µl) | 2 µl |
| dNTP (10 mM) | 2 µl | Phusion (polymerase) | 1 µl |
| oligo 1 (10 µM) | 2 µl | dH$_2$O | 71 µl |
| oligo 2 (10 µM) | 2 µl | | |

TABLE 11

PCR reaction conditions

| Temperature | Cycle length | Number of cycles |
|---|---|---|
| 98° C. | 2 min | 1 |
| 98° C. | 10 sec | 35 |

TABLE 11-continued

| PCR reaction conditions | | |
|---|---|---|
| Temperature | Cycle length | Number of cycles |
| 61° C. | 30 sec | |
| 72° C. | 20 sec | |
| 72° C. | 10 min | 1 |

Preparation of expression plasmids and transformation of S. cerevisiae was performed as described in WO2012/150319 (incorporated herein by reference), employing the 24 (pDB5027-9, pDB5032 and pDB5091-92), or 48 hour stocking method (all remaining variants). The host strain for pDB4990-5, pDB4997-5004, pDB5042-5046, pDB5027-32 and pDB5091-2 was S. cerevisiae DYB7 (Payne et al (2008) Applied and Environmental Microbiology Vol 74(24): 7759-7766) with four copies of PDI integrated into the genome. The host strain for the remaining plasmids was S. cerevisiae BXP10cir⁰ as described in WO2012/150319 (incorporated herein by reference). Protein isolation and purification from shake flask was performed as described in WO2011/051489.

Example 2. SPR Analysis of Binding Affinity of WT HSA and Variants to shFcRn SPR analyses were performed on a Biacore 3000 instrument (GE Healthcare). Immobilisation was carried out on CM5 chips coupled with His-tagged shFcRn (FcRn produced by GeneArt, Life Technologies) using GE Healthcare amine coupling chemistry as per the manufacturer's instructions. Immobilised levels of shFcRn-HIS (shFcRn with a 6-His tail on the C-terminus of beta-2-microglobulin) were 1200-2500RU and achieved by injecting 20 μg/mL shFcRn diluted using sodium acetate pH4.5 (G E Healthcare). Chip surface was left to stabilize with a constant flow (5 μL/min) of running buffer—Di-basic/Mono-basic phosphate buffer pH5.5 ((67 mM phosphate buffer, 0.15 M NaCl, 0.005% Tween 20) at pH 5.5)) at 25° C. (i.e. ambient temperature) overnight. After ligand stabilization, the chip surface was conditioned by injecting 5-12×45 μL Di-basic/Mono-basic phosphate buffer at 30 μL/min followed by HBS_EP (0.01 M HEPES, 0.15 M NaCl, 3 mM EDTA, 0.005% surfactant P20) at pH 7.4 (GE Healthcare)) regeneration steps (12 s) in between each injection. Surfaces were then checked for activity by injecting 3×45 μL positive control (wt HSA (SEQ ID NO: 2)) at 30 μL/min, followed by 12 s regeneration pulse. Kinetic measurements were performed by injecting dilutions (100 μM-0.016 μM) of HSA and HSA variants at 30 μL/min over immobilised shFcRn, at 25° C. (i.e. ambient temperature). The reference cell value was then subtracted and Biaevaluation software 4.1 used to obtain kinetic data and confirm KD values. The variants were wild-type albumin (SEQ ID NO: 2) and albumins with alterations at one or more of positions 492, 550, 573, 574 and 580. The variants were analysed by SPR to determine their binding response (RU) to shFcRn. Some variants were further characterized to determine KD values. The data are shown in Tables 12 to 18.

TABLE 12

Binding affinity of selected albumin variants (with a single alteration) to shFcRn

| Run | Analyte | SEQ ID No. | Binding response (RU) | % increase in binding affinity compared to WT |
|---|---|---|---|---|
| A | WT HSA | 2 | 157 | — |
| | HSA-K573P | 3 | 247 | 57.3 |
| | HSA-E492D | 34 | 192 | 22.5 |
| | HSA-E492F | 35 | 200 | 27.6 |
| | HSA-E492G | 36 | 187 | 19.4 |
| | HSA-E492H | 37 | 186 | 18.8 |
| | HSA-E492M | 41 | 184 | 17.5 |
| | HSA-E492R | 45 | 184 | 17.5 |
| B | WT HSA | 2 | 150 | — |
| | HSA-K573P | 3 | 211 | 40.7 |
| | HSA-D550E | 53 | 175 | 16.8 |
| | HSA-D550K | 58 | 186 | 24.4 |
| | HSA-D550L | 59 | 187 | 24.6 |
| | HSA-D550M | 60 | 177 | 18.0 |
| | HSA-D550R | 64 | 177 | 18.2 |
| C | WT HSA | 2 | 171 | — |
| | HSA-K573P | 3 | 223 | 30.4 |
| | HSA-K574D | 72 | 214 | 25.4 |
| | HSA-K474F | 74 | 219 | 27.1 |
| | HSA-K574G | 75 | 225 | 31.7 |
| | HSA-K574H | 76 | 230 | 34.7 |
| | HSA-K574N | 80 | 205 | 20.4 |
| | HSA-K574S | 84 | 205 | 20.1 |
| | HSA-K574Y | 87 | 207 | 21.1 |
| D | WT HSA | 2 | 159 | — |
| | HSA-K573P | 3 | 227 | 42.8 |
| | HSA-Q580K | 97 | 212 | 33.4 |
| | HSA-Q580R | 102 | 195 | 22.3 |

The data in Table 12 show that variants comprising an alteration at one of positions 492, 550, 574 and 580 show a higher FcRn binding affinity than WT albumin.

TABLE 13

Binding affinity of albumin variants (with two alterations) to shFcRn

| Analyte | SEQ ID No. | Binding response (RU) | % increase in binding affinity compared to WT |
|---|---|---|---|
| WT HSA | 2 | 242.3 | — |
| HSA-K573P | 3 | 278.0 | 14.7 |
| HSA-E492D + K573P | 108 | 270.8 | 11.8 |
| HSA-E492F + K573P | 109 | 270.3 | 11.6 |
| HSA-E492G + K573P | 110 | 275.7 | 13.8 |

The data in Table 13 show that variants comprising alterations at position 492 in conjunction with the K573P variant show higher binding affinity than WT albumin.

TABLE 14

Binding affinity of albumin variants to shFcRn

| Analyte | SEQ ID NO: | Ka ($10^3$/Ms) | Kd ($10^{-3}$/s) | KD (μM) | Mean KD (μM) | Fold difference from HSA-WT |
|---|---|---|---|---|---|---|
| WT HSA (run 1) | 2 | 10.9 | 40 | 3.67 | 4.02 | — |
| WT HSA (run 2) | 2 | 9.15 | 39.9 | 4.36 | | |
| HSA-K573P (run 1) | 3 | 5.99 | 2.15 | 0.358 | 0.39 | 10.3 |
| HSA-K573P (run 2) | 3 | 5.95 | 2.53 | 0.426 | | |
| HSA-E492D + K573P (run 1) | 108 | 11.5 | 1.68 | 0.147 | 0.162 | 24.8 |
| HSA-E492D + K573P (run 2) | 108 | 11.1 | 1.96 | 0.177 | | |

TABLE 14-continued

Binding affinity of albumin variants to shFcRn

| Analyte | SEQ ID NO: | Ka (10³/Ms) | Kd (10⁻³/s) | KD (μM) | Mean KD (μM) | Fold difference from HSA-WT |
|---|---|---|---|---|---|---|
| HSA-E492G + K573P (run 1) | 110 | 12.7 | 2.15 | 0.17 | 0.175 | 23.0 |
| HSA-E492G + K573P (run 2) | 110 | 11.3 | 2.04 | 0.18 | | |

Variants HSA-E492D+K573P and HSA-E492G+K573P were selected for further analysis based on their apparent slow 'off rates' (i.e. dissociation constants (Kd)). The data in Table 14 show that variants HSA-E492D+K573P and HSA-E492G+K573P show higher affinity for shFcRn as compared to WT albumin and the single K573P variant.

TABLE 15

Binding affinity of albumin variants (with two alterations) to shFcRn

| Analyte | SEQ ID No. | Binding response (RU) | % increase in binding affinity compared to WT |
|---|---|---|---|
| WT HSA | 2 | 40.7 | — |
| HSA-K573P | 3 | 55.3 | 35.9 |
| HSA-K574D + K573P | 121 | 47.2 | 16.0 |
| HSA-K574F + K573P | 122 | 49.2 | 20.9 |
| HSA-K574G + K573P | 123 | 52.1 | 28.0 |
| HSA-K574H + K573P | 124 | 53.4 | 31.2 |
| HSA-K574N + K573P | 125 | 38.4 | −5.7 |
| HSA-K574S + K573P | 126 | 40.8 | 0.2 |
| HSA-Q580K + K573P | 128 | 53.7 | 31.9 |
| HSA-Q580R + K573P | 129 | 29.3 | −28.0 |

The data in Table 15 show that introduction of substitutions to the K573P variant which had individually demonstrated an improvement in affinity for shFcRn (Table 12), produced a range of binding responses, from a reduction in affinity as compared to WT albumin, through to variants showing increased affinity.

TABLE 16

Binding affinity of albumin variants to shFcRn

| Analyte | SEQ ID NO: | Ka (10³/Ms) | Kd (10⁻³/s) | KD (μM) | Mean KD (μM) | Fold difference from WT HSA |
|---|---|---|---|---|---|---|
| WT HSA | 2 | 17.3 | 63.0 | 3.6 | 3.6 | — |
| HSA-K573P (run 1) | 3 | 8.1 | 3.4 | 0.42 | 0.46 | 7.8 |
| HSA-K573P (run 2) | 3 | 8.0 | 4.0 | 0.5 | | |
| HSA-E492H + K573P (run 1) | 111 | 11.2 | 3.7 | 0.33 | 0.37 | 9.7 |
| HSA-E492H + K573P (run 2) | 111 | 11.4 | 4.7 | 0.41 | | |
| HSA-E492R + K573P | 113 | 10.3 | 4.3 | 0.42 | 0.42 | 8.6 |
| HSA-K574G + K573P (run 1) | 123 | 11.5 | 5.5 | 0.48 | 0.53 | 6.8 |
| HSA-K574G + K573P (run 2) | 123 | 11.7 | 6.8 | 0.58 | | |
| HSA-K574H + K573P (run 1) | 124 | 12.6 | 2.7 | 0.22 | 0.25 | 14.4 |
| HSA-K574H + K573P (run 2) | 124 | 10.8 | 3.08 | 0.29 | | |

TABLE 16-continued

Binding affinity of albumin variants to shFcRn

| Analyte | SEQ ID NO: | Ka (10³/Ms) | Kd (10⁻³/s) | KD (μM) | Mean KD (μM) | Fold difference from WT HSA |
|---|---|---|---|---|---|---|
| HSA-Q580K + K573P (run 1) | 128 | 13.4 | 1.9 | 0.14 | 0.15 | 24.0 |
| HSA-Q580K + K573P (run 2) | 128 | 13.2 | 2.19 | 0.16 | | |

The data in Table 16 show that variants HSA-K574H+K573P and HSA-Q580K+K573P possess considerably higher affinity for shFcRn as compared to WT albumin and the single K573P variant.

TABLE 17

Binding affinity of albumin variants to shFcRn

| Analyte | SEQ ID NO: | Ka (10³/MS) | Kd (10³/s) | KD (μM) | Mean KD (μM) | Fold difference from WT HSA |
|---|---|---|---|---|---|---|
| WT HSA | 2 | 9.7 | 72.2 | 7.4 | 6.9 | — |
| | | 8.9 | 57.3 | 6.4 | | |
| HSA-K573P | 3 | 6.1 | 3.9 | 0.64 | 0.7 | 9.9 |
| | | 5.4 | 4.1 | 0.76 | | |
| HSA-D550K + K573P | 117 | 7.1 | 2.8 | 0.4 | 0.5 | 13.8 |
| | | 5.6 | 3.3 | 0.6 | | |
| HSA-D550K + K574H | 130 | 10.1 | 36.6 | 3.6 | 3.75 | 1.8 |
| | | 8.8 | 34.8 | 3.9 | | |
| HSA-D550K + Q580K | 132 | 12.9 | 22.6 | 1.7 | 1.6 | 4.3 |
| | | 11.9 | 18.5 | 1.5 | | |
| HSA-D550K + K574H + K573P | 131 | 6.5 | 1.6 | 0.25 | 0.31 | 22.3 |
| | | 6.2 | 2.4 | 0.38 | | |
| HSA-K574H + Q580K + K573P | 135 | 7.5 | 1.9 | 0.26 | 0.28 | 24.6 |
| | | 6.0 | 1.8 | 0.3 | | |

The data in Table 17 show varying effects of the introduction of mutations at positions 550, 573, 574 and 580. For example, HSA-K574H+K573P showed increased binding compared to WT albumin (Table 16). Introduction of the K574H mutation into HSA-Q580K+K573P (Table 16) to produce HSA-K574H+Q580K+K573P resulted in no improvement in binding affinity (compared to WT albumin) over HSA-Q580K+K573P. In contrast, introduction of this mutation into HSA-D550K+K573P, producing HSA-D550K+K574H+K573P, has resulted in an increase in affinity compared to WT albumin and HSA-D550K+K573P.

TABLE 18

Binding affinity of albumin variants to shFcRn

| Analyte | SEQ ID NO: | Run | Cycle | Ka (10³/MS) | Kd (10³/s) | KD (μM) | Mean KD (μM) | Fold difference from WT HSA |
|---|---|---|---|---|---|---|---|---|
| WT HSA | 2 | 1 | 1 | 11.1 | 68.1 | 6.1 | 7.10 | — |
|  |  | 2 | 1 | 11.2 | 89.3 | 8.0 |  |  |
|  |  |  | 2 | 12.5 | 90.8 | 7.2 |  |  |
| HSA-K573P | 3 | 1 | 1 | 6.0 | 3.8 | 0.64 | 0.86 | 8.3 |
|  |  | 2 | 1 | 5.0 | 5.3 | 1.1 |  |  |
|  |  |  | 2 | 5.4 | 4.5 | 0.83 |  |  |
| E492D + K573P + K574H + Q580K | 114 | 1 | 1 | 7.8 | 1.3 | 0.16 | 0.18 | 39.4 |
|  |  | 2 | 1 | 7.3 | 1.6 | 0.21 |  |  |
|  |  |  | 2 | 7.9 | 1.3 | 0.16 |  |  |
| E492G + K573P + K574H + Q580K | 115 | 1 | 1 | 7.8 | 1.3 | 0.16 | 0.22 | 32.3 |
|  |  | 2 | 1 | 7.0 | 1.7 | 0.25 |  |  |
|  |  |  | 2 | 5.3 | 1.3 | 0.24 |  |  |

The data in Table 18 show that variants containing four substitutions at positions 492 573P, 574 and 580 show a marked increase in binding affinity as compared to variants containing three mutations, such as HSA-K574H+Q580K+K573P (Table 17), variants containing two mutations, such as K574H+K573P and Q580K+K573P (Table 16) and the single K573P variant or WT albumin.

Example 3. Production of Further Combination Variants

Single or multiple further mutations were introduced into the template plasmids listed in Table 19 to produce the indicated variants. Mutagenic forward primers and non-mutagenic reverse primers were used to introduce the desired changes, as listed in Table 20. The template plasmids were methylated using the components described in Table 21, incubated at 37° C. for one hour and were then purified using a Qiagen QiaQuick PCR purification kit according to manufacturer's instructions. The methylated template was then used in mutagenic PCR reactions (Tables 22 and 23) according to the oligonucleotide/template combination detailed in Table 19 to produce the required HSA variants. Following PCR reaction, 5 μl of each PCR reaction mixture was visualised by agarose gel electrophoresis to assess production of the plasmid and 5 μl of plasmid was retained for further analysis.

TABLE 19

Variants and associated templates and oligonucleotides for mutagenic PCR amplification

| Variant | Oligo forward | Oligo reverse | Template | Seq ID no. |
|---|---|---|---|---|
| HSA E492D + D550K | 01-f | 01-r | pDB4770 | 231 |
| HSA E492D + K574H | 02-f | 02-r | pDB4770 | 232 |
| HSA E492D + K573P + K574H | 04-f | 04-r | pDB4770 | 233 |
| HSA E492D + K573P + Q580K | 05-f | 05-r | pDB4770 | 234 |
| HSA E492D + K573P + K574G + Q580K | 06-f | 06-r | pDB4770 | 235 |
| HSA E492D + K573P + K574H + Q580R | 07-f | 07-r | pDB4770 | 236 |
| HSA E492F + K573P + K574H + Q580K | 08-f | 08-r | pDB4771 | 237 |
| HSA E492F + K573P + K574G + Q580K | 06-f | 06-r | pDB4771 | 238 |
| HSA E492F + K573P + K574H + Q580R | 07-f | 07-r | pDB4771 | 239 |
| HSA E492G + D550K | 01-f | 01-r | pDB4772 | 240 |

TABLE 19-continued

Variants and associated templates and oligonucleotides for mutagenic PCR amplification

| Variant | Oligo forward | Oligo reverse | Template | Seq ID no. |
|---|---|---|---|---|
| HSA E492G + K574H | 02-f | 02-r | pDB4772 | 241 |
| HSA E492G + K573P + Q580K | 05-f | 05-r | pDB4772 | 242 |
| HSA E492G + K573P + K574G + Q580K | 06-f | 06-r | pDB4772 | 243 |
| HSA E492G + K573P + K574H + Q580R | 07-f | 07-r | pDB4772 | 244 |
| HSA D550L + K574H | 02-f | 02-r | pDB4791 | 245 |
| HSA D550L + K573P + K574H | 04-f | 04-r | pDB4791 | 246 |
| HSA D550L + Q580K | 03-f | 03-r | pDB4791 | 247 |
| HSA D550L + K573P + Q580K | 05-f | 05-r | pDB4791 | 248 |
| HSA D550M + K574H | 02-f | 02-r | pDB4792 | 249 |
| HSA D550M + K573P + K574H | 04-f | 04-r | pDB4792 | 250 |
| HSA D550M + Q580K | 03-f | 03-r | pDB4792 | 251 |
| HSA D550M + K573P + Q580K | 05-f | 05-r | pDB4792 | 252 |
| HSA E492D + D550K + K573P | 01-f | 01-r | pDB4990 | 253 |
| HSA E492G + D550K + K573P | 01-f | 01-r | pDB4992 | 254 |
| HSA E492G + D550K + K574H | 29-f | 29-r | pDB5027 | 255 |
| HSA E492D + D550K + K573P + K574H | 28-f | 28-r | pDB5028 | 256 |
| HSA E492G + D550K + K573P + K574H | 29-f | 29-r | pDB5028 | 257 |
| HSA E492D + D550K + Q580K | 28-f | 28-r | pDB5029 | 258 |
| HSA E492G + D550K + Q580K | 29-f | 29-r | pDB5029 | 259 |
| HSA E492D + D550K + K573P + Q580K | 28-f | 28-r | pDB5030 | 260 |
| HSA E492G + D550K + K573P + Q580K | 29-f | 29-r | pDB5030 | 261 |
| HSA E492D + K574H + Q580K | 28-f | 28-r | pDB5031 | 262 |
| HSA E492G + K574H + Q580K | 29-f | 29-r | pDB5031 | 263 |
| HSA E492D + K573P + K574H + Q580K | 28-f | 28-r | pDB5032 | 264 |
| HSA D550K + K573P + K574H + Q580K | 01-f | 01-r | pDB5032 | 265 |
| HSA E492D + D550K + K573P + K574H + Q580K | 01-f | 01-r | pDB5091 | 266 |
| HSA E492G + D550K + K573P + K574H + Q580K | 01-f | 01-r | pDB5092 | 267 |

(f = forward, r = reverse)

TABLE 20

Oligonucleotides for mutagenic PCR amplification.

| Oligo | Sequence (5' to 3') | SEQ ID No. |
|---|---|---|
| 01-f | GAACAATTGAAGGCTGTCATGGATAAGTTCGCTGCTTTCGTTGAAAAG | 268 |
| 01-r | ATCCATGACAGCCTTCAATTGTTCCTTAGTAGCCTT | 269 |
| 02-f | CTTGTTTCGCTGAAGAAGGTAAGCACTTGGTCGCTGCTTCCCAA | 270 |
| 02-r | CTTACCTTCTTCAGCGAAACAAGTTTCCTTATCATC | 271 |
| 03-f | TAAGAAGTTGGTCGCTGCTTCCAAGGCTGCCTTAGGTTTGTAATAA | 272 |
| 03-r | GGAAGCAGCGACCAACTTCTTACCTTCTTCAGC | 273 |
| 04-f | GAAACTTGTTTCGCTGAAGAAGGTCCACACTTGGTCGCTGCTTCCCAA | 274 |
| 04-r | ACCTTCTTCAGCGAAACAAGTTTCCTTATCATCAGC | 275 |
| 05-f | GAAACTTGTTTCGCTGAAGAAGGTCCAAAGTTGGTCGCTGCTTCCAAGGCTGCCTTAGGTTTGTAA | 276 |
| 05-r | ACCTTCTTCAGCGAAACAAGTTTCCTTATCATCAGC | 277 |
| 06-f | GAAACTTGTTTCGCTGAAGAAGGTCCAGGTTTGGTCGCTGCTTCCAAGGCTGCCTTAGGTTTGTAA | 278 |
| 06-r | ACCTTCTTCAGCGAAACAAGTTTCCTTATCATCAGC | 279 |
| 07-f | GAAACTTGTTTCGCTGAAGAAGGTCCACACTTGGTCGCTGCTTCCAGAGCTGCCTTAGGTTTGTAA | 280 |
| 07-r | ACCTTCTTCAGCGAAACAAGTTTCCTTATCATCAGC | 281 |
| 08-f | GAAACTTGTTTCGCTGAAGAAGGTCCACACTTGGTCGCTGCTTCCAAGGCTGCCTTAGGTTTGTAA | 282 |
| 08-r | ACCTTCTTCAGCGAAACAAGTTTCCTTATCATCAGC | 283 |
| 28-f | GAAGACCATGTTTCTCTGCTTTGGACGTCGACGAAACTTACGTTC | 284 |
| 28-r | CAAAGCAGAGAAACATGGTCTTCTGTTAACCAAAGA | 285 |
| 29-f | GAAGACCATGTTTCTCTGCTTTGGGTGTCGACGAAACTTACGTTC | 286 |
| 29-r | CAAAGCAGAGAAACATGGTCTTCTGTTAACCAAAGA | 287 |

(f = forward, r = reverse)

TABLE 21

| Methylation reaction components | |
|---|---|
| Template DNA | 2.5 μg |
| 10X Buffer (New England Biolabs) | 5 μl |
| Dam methylase (New England Biolabs) | 1 μl |
| S adenosylmethionine (80 μM) (New England Biolabs) | 12.5 μl |
| H₂O | Up to 50 μl |

TABLE 22

| PCR reaction components | | | |
|---|---|---|---|
| Template (5 ng/μl) | 1 μl | Forward primer (20 μM) | 1.25 μl |
| 5x buffer | 10 μl | Reverse primer (20 μM) | 1.25 μl |
| dNTP (10 mM) | 1 μl | Q5 polymerase | 0.5 μl |
| Sterile water | 35 | | |

TABLE 23

| PCR reaction conditions for construction of variants listed in Table 19 | | |
|---|---|---|
| Temperature | Cycle Length | Number of cycles |
| 98° C. | 2 min | 1 |
| 98° C. | 10 sec | 30 |
| 65° C.*/60° C.# | 30 sec | |
| 72° C. | 5 min | |
| 72° C. | 7 min | 1 |

40 μl of each of the PCR-generated plasmids was prepared for in vivo recombination by the addition of 0.5 μl of each of DpnI, NsiI and PvuI restriction enzymes (New England Biolabs), followed by incubation at 37° C. for one hour. 3 μl of the prepared plasmid, 3 μl of Acc65I/BamHI-digested pDB3936 and 1 μl of salmon sperm DNA were used to transform *S. cerevisiae* according to the protocol described in Example 1. The host strain used was a *S. cerevisiae* strain derived from DYB7 ura3 (Payne et al 2008, Appl. Environ. Microbiol. 74(24): 7759-7766) with two additional copies of PDI1 integrated into the genome. Single colonies were patched onto BMMD+CSM-leu plates (as described in WO 2012/150319, incorporated herein by reference) to enable assessment of expression prior to production of yeast stocks. Stocks were produced by the 48-hour method described in Example 1. 200 µl of each yeast strain was used to inoculate 10 ml BMMS in 50 ml shake flask, followed by incubation at 30° C., 200 rpm for four days. Culture supernatant was harvested by centrifugation at 3000 rpm for 5 minutes.

Albumin variants were purified from 10 mL shake flasks using a single chromatographic step with an albumin affinity matrix (AlbuPure™—ProMetic BioSciences, Inc.). Microscale affinity chromatography was performed on an automated platform (Perkin Elmer, Janus) with 200 µL custom packed Atoll columns with 8 run in parallel in a 96-well format using the same procedure as described in WO 2011/051489 (incorporated herein by reference), with volumes scaled down appropriately.

Final concentration of the samples was determined by Absorbance at 280 nm using a UV microplate and a plate reader, readings were blank corrected against PBS and the concentrations calculated based on an extinction coefficient of 0.52 AU/cm for a 1 mg/mL solution (AU: absorbance units).

Example 4. Analysis of Further Combination Variants

Kinetic analyses using bio-layer interferometry were performed on an Octet Red-96 instrument (ForteBio). Immobilisation of GST-tagged shFcRn (shFcRn-GST/FLAG) was carried out on AR2G biosensors using ForteBio amine coupling chemistry following the instructions from the manufacturer. shFcRn-GST/FLAG—refers to GST—tag (glutathione-transferase) and a FLAG-tag (DYKDDDDK) on the C-terminal of the alpha chain of FcRn. Prior to use, the GST/FLAG-tagged shFcRn was purified using IgG affinity chromatography. More specifically, the GST/FLAG-tagged shFcRn was captured on a GSTrap column and eluted with reduced glutathione. shFcRn was dialyzed into PBS into pH 7.4 and further purified using IgG Sepharose™ 6 Fast Flow (GE Healthcare). The shFcRn was captured on the resin in 50 mM Na-acetate, 150 mM NaCl pH 5.5 and eluted with PBS pH 7.4. The eluted shFcRn was concentrated to 2-5 mg/mL and stored at −20° C. until use. Immobilised level of shFcRn-GST/FLAG was at a response level more than 1 nm, and achieved using a FcRn concentration of 2-10 µg/mL in sodium acetate, followed by ethanolamine quenching of the amine coupling reaction. The sensors were either used directly or soaked in 15% (w/v) sucrose and dried until use.

Kinetic analyses were performed using micro-scale affinity purified albumin variants diluted 2-, 4- and 8-fold in BMMD fermentation media (as described WO 2011/051489, incorporated herein by reference) supplemented with 100 mM sodium acetate and adjusted to pH 5.5. Association (120 s) and dissociation (300 s) were performed at 30° C. and shaking at 1000 rpm. ForteBio software was used for data evaluation and calculation of KD values as well as association and dissociation constants which were calculated using the HSA concentrations determined by OD280 nm measurement.

TABLE 24

Binding affinity of albumin variants to shFcRn

| SEQ ID No: | Variant | KD Average µM | Fold difference relative to WT HSA |
|---|---|---|---|
| 231 | HSA E492D + D550K | 0.12 | 1.2 |
| 232 | HSA E492D + K574H | 0.14 | 1.1 |
| 233 | HSA E492D + K573P + K574H | 0.04 | 3.8 |
| 234 | HSA E492D + K573P + Q580K | 0.03 | 5.8 |
| 235 | HSA E492D + K573P + K574G + Q580K | 0.04 | 3.9 |
| 236 | HSA E492D + K573P + K574H + Q580R | 0.03 | 5.5 |
| 237 | HSA E492F + K573P + K574H + Q580K | 0.03 | 6.0 |
| 238 | HSA E492F + K573P + K574G + Q580K | 0.06 | 2.6 |
| 239 | HSA E492F + K573P + K574H + Q580R | 0.03 | 4.5 |
| 240 | HSA E492G + D550K | 0.13 | 1.2 |
| 241 | HSA E492G + K574H | 0.14 | 1.1 |
| 242 | HSA E492G + K573P + Q580K | 0.03 | 5.8 |
| 243 | HSA E492G + K573P + K574G + Q580K | 0.04 | 3.9 |
| 244 | HSA E492G + K573P + K574H + Q580R | 0.03 | 5.5 |
| 245 | HSA D550L + K574H | 0.06 | 2.4 |
| 246 | HSA D550L + K573P + K574H | 0.04 | 4.2 |
| 247 | HSA D550L + Q580K | 0.10 | 1.5 |
| 248 | HSA D550L + K573P + Q580K | 0.03 | 5.9 |
| 249 | HSA D550M + K574H | 0.13 | 1.2 |
| 250 | HSA D550M + K573P + K574H | 0.03 | 5.0 |
| 251 | HSA D550M + Q580K | 0.10 | 1.5 |
| 252 | HSA D550M + K573P + Q580K | 0.02 | 7.2 |
| 253 | HSA E492D + D550K + K573P | 0.03 | 4.8 |
| 254 | HSA E492G + D550K + K573P | 0.03 | 4.5 |
| 255 | HSA E492G + D550K + K574H | 0.12 | 1.3 |
| 256 | HSA E492D + D550K + K573P + K574H | 0.03 | 4.6 |
| 258 | HSA E492D + D550K + Q580K | 0.09 | 1.7 |
| 259 | HSA E492G + D550K + Q580K | 0.08 | 1.8 |
| 260 | HSA E492D + D550K + K573P + Q580K | 0.03 | 5.2 |
| 261 | HSA E492G + D550K + K573P + Q580K | 0.02 | 6.1 |
| 262 | HSA E492D + K574H + Q580K | 0.11 | 1.4 |
| 263 | HSA E492G + K574H + Q580K | 0.08 | 1.9 |
| 264 | HSA E492D + K573P + K574H + Q580K | 0.03 | 5.3 |
| 265 | HSA D550K + K573P + K574H + Q580K | 0.02 | 6.1 |
| 266 | HSA E492D + D550K + K573P + K574H + Q580K | 0.02 | 6.5 |
| 267 | HSA E492G + D550K + K573P + K574H + Q580K | 0.02 | 6.9 |
| 2 | WT HSA | 0.15 | 1.0 |

Example 5. Further Analysis of Selected Combination Variants

A subset of the variants (Table 25) described in Table 19 were selected for further analysis. 3 µl of the PCR reactions were digested with 7 µl of a reaction mix containing 10 µl of buffer 4 (New England Biolabs), 5 µl DpnI and 55 µl of water. Reaction mixtures were incubated at 37° C. for 1.5 hours and were then purified using a Qiagen QiaQuick PCR purification kit according to manufacturer's instructions. 2 µl of the prepared plasmids were used to transform competent E. coli 10-beta cells (New England Biolabs). Plasmid DNA was prepared utilising a Qiagen Plus Maxiprep kit, according to manufacturer's instructions. The resulting plasmids were sequenced to ensure the desired mutations had been introduced. Plasmid preparation and yeast transformations were performed as described in example 1, using strain BXP10 cir⁰. 24 hour yeast stocks were produced as described in example 1.

TABLE 25

Variant and plasmid number

| Variant | Plasmid | Construct | SEQ ID No |
|---|---|---|---|
| HSA E492D + K574H | pDB5386 | HSAE-2 | 232 |
| HSA E492D + K573P + Q580K | pDB5387 | HSAE-5 | 234 |
| HSA D550L + K573P + K574H | pDB5388 | HSAE-19 | 246 |
| HSA D550L + K573P + Q580K | pDB5389 | HSAE-21 | 248 |
| HSA D550M + Q580K | pDB5390 | HSAE-24 | 251 |
| HSA E492D + D550K + K573P | pDB5391 | HSAE-26 | 253 |
| HSA E492G + D550K + K573P | pDB5392 | HSAE-27 | 254 |
| HSA E492G + D550K + K573P + K574H | pDB5393 | HSAE-31 | 257 |

The variants listed in Table 26 and 27 were analyzed by SPR using a Biacore 3000 instrument as described in Example 2 with the exception that, prior to use, the His-tagged shFcRn was purified using IgG affinity chromatography. More specifically, the His-tagged shFcRn was captured on a Ni-HiTrap column and eluted with imidazole. The shFcRn was captured on the resin in 50 mM Na-acetate, 150 mM NaCl pH 5.5 and eluted with PBS pH 7.4. The eluted shFcRn was concentrated to 2-5 mg/mL and stored at −20° C. until use. using shFcRn-HIS

TABLE 26

SPR analysis of binding affinity of HSA variants to shFcRn

| Variant | SEQ ID No | Ka ($10^3$/Ms) | Kd ($10^{-3}$/s) | KD μM | Fold difference relative to WT HSA |
|---|---|---|---|---|---|
| HSA WT | 2 | 10.2 | 76.3 | 7.5 | — |
| HSA K573P | 3 | 11.2 | 7.1 | 0.63 | 11.9 |
| HSA E492D + K574H | 232 | 17.5 | 48.7 | 2.8 | 2.7 |
| HSA E492D + K573P + Q580K | 234 | 19.5 | 2.2 | 0.11 | 68.2 |
| HSA D550L + K573P + K574H | 246 | 15.6 | 3.6 | 0.23 | 32.6 |
| HSA D550M + Q580K | 251 | 21.1 | 28.2 | 1.3 | 5.8 |
| HSA E492D + D550K + K573P | 253 | 17.6 | 3.2 | 0.18 | 41.7 |
| HSA E492G + D550K + K573P | 254 | 20.0 | 3.2 | 0.16 | 46.9 |
| HSA E492G + D550K + K573P + K574H | 257 | 17.0 | 2.6 | 0.15 | 50 |

TABLE 26-continued

SPR analysis of binding affinity of HSA variants to shFcRn

| Variant | SEQ ID No | Ka ($10^3$/Ms) | Kd ($10^{-3}$/s) | KD μM | Fold difference relative to WT HSA |
|---|---|---|---|---|---|
| HSA D550L + K573P + Q580K | 248 | 18.0 | 1.7 | 0.09 | 83.3 |

TABLE 27

SPR analysis of binding affinity of HSA variants to shFcRn

| Variant | SEQ ID No | Ka ($10^3$/Ms) | Kd ($10^{-3}$/s) | KD μM | Fold difference relative to WT HSA |
|---|---|---|---|---|---|
| HSA WT | 2 | 16.7 | 101 | 6.1 | — |
| HSA K573P | 3 | 16.4 | 9.75 | 0.6 | 10.2 |
| HSA D550K + K573P + K574H | 131 | 27.5 | 4.4 | 0.16 | 38.1 |
| HSA K573P + K574H + Q580K | 135 | 24.7 | 3.2 | 0.13 | 46.9 |
| HSA D550K + K573P + Q580K | 133 | 44.2 | 1.9 | 0.05 | 122 |
| HSA D550L + K573P + Q580K | 248 | 36.3 | 2.12 | 0.06 | 101.7 |

The data of Table 26 and 27 show an improvement in affinity over WT HSA in variants containing a combination of substitutions. Generally, variants containing three or four substitutions show improved binding characteristics over those containing two substitutions. Generally, inclusion of Q580K contributes substantially to an improved binding affinity.

The invention described and claimed herein is not to be limited in scope by the specific aspects herein disclosed, since these aspects are intended as illustrations of several aspects of the invention. Any equivalent aspects are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

SEQUENCE LISTING (287 sequences)

SEQ ID NO: 1 - DNA, 1758 bp, Homo sapiens
  misc_feature (1)..(1758): cDNA encoding HSA
gatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataa

SEQ ID NO: 2 - protein, 585 aa, Homo sapiens [sequence omitted]

SEQ ID NO: 3 - protein, 585 aa, Artificial Sequence
  HSA K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 4 - protein, 609 aa, Homo sapiens [sequence omitted]

SEQ ID NO: 5 - protein, 621 aa, Pan troglodytes
MNESSCCSTSLPAFGVSVLDSGHSSSSAYSRGVFRRDAHKSEVAHRFKDLGEENFKALVLVAFAQYLQQCPFEDHVKLVNEVTEFAKTCVADESAENCDKSLHTLFGDKLCTVATLREKYGEMADCCAKQEPERNECFLQHKDDNPNLPRLVRPEVDVMCTAFHDNEGTFLKKYLYEVARRHPYFYAPELLFFAERYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCLAEVENDEMPADLPSLAADFVESKEVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 6 - protein, 608 aa, Macaca mulatta
MKWVTFISLLFLFSSAYSRGVFRRDTHKSEVAHRFKDLGEEHFKGLVLVAFSQYLQQCPFEEHVKLVNEVTEFAKTCVADESAENCDKSLHTLFGDKLCTVATLRETYGEMADCCAKQEPERNECFLQHKDDNPNLPPLVRPEVDVMCTAFHDNEATFLKKYLYEVARRHPYFYAPELLFFAARYKAAFAECCQAADKAACLLPKLDELRDEGKASSAKQRLKCASLQKFGDRAFKAWAVARLSQKFPKAEFAEVSKLVTDLTKVHTECCHGDLLECADDRADLAKYMCENQDSISSKLKECCDKPLLEKSHCLAEVENDEMPADLPSLAADYVESKDVCKNYAEAKDVFLGMFLYEYARRHPDYSVMLLLRLAKAYEATLEKCCAAADPHECYAKVFDEFQPLVEEPQNLVKQNCELFEQLGEYKFQNALLVRYTKKVPQVSTPTLVEVSRNLGKVGAKCCKLPEAKRMPCAEDYLSVVLNRLCVLHEKTPVSEKVTKCCTESLVNRRPCFSALELDEAYVPKAFNAETFTFHADMCTLSEKEKQVKKQTALVELVKHKPKATKEQLKGVMDNFAAFVEKCCKADDKEACFAEEGPKFVAASQAALA

SEQ ID NO: 7 - protein, 608 aa, Mesocricetus auratus
MKWVTFLLLLFVSDSAFSRGLFRRDAHKSEIAHRFKDLGEQHFKGLVLIAFSQFLQKCPYEEHVKLVNEVTDFAKTCVADESAENCDKSLHTLFGDKLCAIPTLRDSYGELADCCAKKEPERNECFLKHKDDHPNLPPFVRPDAEAMCTSFQENAVTFMGHYLHEVARRHPYFYAPELLYYAEKYSAIMTECCGEADKAACITPKLDALKEKALASSVNQRLKCSSLQRFGQRAFKAWAVARMSQKFPKADFAEITKLATDLTKLTEECCHGDLLECADDRAELAKYMCENQASISSKLQACCDKPVLKKSHCLSEVENDDLPADLPSLAADFVEDKEVCKNYAEAKDVFLGTFLYEYARRHPDYSVALLLRLAKKYEATLEKCCAEADPSACYGKVLDEFQPLVEEPKNLVKANCELFEKLGEYGFQNALIVRYTQKAPQVSTPTLVEAARNLGKVGSKCCVLPEAQRLPCVEDYISAILNRVCVLHEKTPVSEQVTKCCTGSVVERRPCFSALPVDETYVPKEFKAETFTFHADICSLPEKEKQMKKQAALVELVKHKPKATGPQLRTVLGEFTAFLDKCCKAEDKEACFSEDGPKLVASSQAALA

SEQ ID NO: 8 - protein, 608 aa, Cavia porcellus
MKWVTFISLLFLFSSVYSRGVFRREAHKSEIAHRFNDLGEGHFKGLVLITLSQHLQKSPFEEHVKLVNEVTDFAKACVADESAQNCGKAIATLFGDKVCAIPSLRETYGELADCCAKEDPDRVECFLQHKDDNPNLPPFERPEPEALCTAFKENNDRFIGHYLYEVSRRHPYFYAPELLYYAEKYKNALTECCEAADKAACLTPKLDAIKEKALVSSAQQRLKCASLQKFGERAFKAWSVARLSQKFPKAEFAEISTIVTSLTKVTKECCHGDLLECADDRQELAKYMCEHQDSISSKLKECCVKPTLQKAHCILEIQRDELPTELPDLAVDFVEDKEVCKNFAEAKDVFLGTFLYEYSRRHPEYSIGMLLRIAKGYEAKLEKCCAEADPHACYAKVFDELQPLIDEPKKLVQQNCELFDKLGEYGFQNALAVRYTQKAPQVSTPTLVEYARKLGSVGTKCCSLPETERLSCTENYLALILNRLCILHEKTPVSERVTKCCTESLVNRRPCFSALHVDETYVPKPFHADSFTFHADICTLPEKEKQVKKQMALVELVKHKPKASEEQMKTVMGDFAAFLKKCCDADNKEACFTEDGPKLVAKCQATLA

SEQ ID NO: 9 - protein, 608 aa, Mus musculus
MKWVTFLLLLFVSGSAFSRGVFRREAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALA

SEQ ID NO: 10 - protein, 608 aa, Rattus norvegicus
MKWVTFLLLLFISGSAFSRGVFRREAHKSEIAHRFKDLGEQHFKGLVLIAFSQYLQKCPYEEHIKLVQEVTDFAKTCVADENAENCDKSIHTLFGDKLCAIPKLRDNYGELADCCAKQEPERNECFLQHKDDNPNLPPFQRPEAEAMCTSFQENPTSFLGHYLHEVARRHPYFYAPELLYYAEKYNEVLTQCCTESDKAACLTPKLDAVKEKALVAAVRQRMKCSSMQRFGERAFKAWAVARMSQRFPNAEFAEITKLATDVTKINKECCHGDLLECADDRAELAKYMCENQATISSKLQACCDKPVLQKSQCLAEIEHDNIPADLPSIAADFVEDKEVCKNYAEAKDVFLGTFLYEYSRRHPDYSVSLLLRLAKKYEATLEKCCAEGDPPACYGTVLAEFQPLVEEPKNLVKTNCELYEKLGEYGFQNAVLVRYTQKAPQVSTPTLVEAARNLGRVGTKCCTLPEAQRLPCVEDYLSAILNRLCVLHEKTPVSEKVTKCCSGSLVERRPCFSALTVDETYVPKEFKAETFTFHSDICTLPDKEKQIKKQTALAELVKHKPKATEDQLKTVMGDFAQFVDKCCKAADKDNCFATEGPNLVARSKEALA

SEQ ID NO: 11 - protein, 607 aa, Bos taurus
MKWVTFISLLLLFSSAYSRGVFRRDTHKSEIAHRFKDLGEEHFKGLVLIAFSQYLQQCPFDEHVKLVNELTEFAKTCVADESHAGCEKSLHTLFGDELCKVASLRETYGDMADCCEKQEPERNECFLSHKDDSPDLPKLKPDPNTLCDEFKADEKKFWGKYLYEIARRHPYFYAPELLYYANKYNGVFQECCQAEDKGACLLPKIETMREKVLASSARQRLRCASIQKFGERALKAWSVARLSQKFPKAEFVEVTKLVTDLTKVHKECCHGDLLECADDRADLAKYICDNQDTISSKLKECCDKPLLEKSHCIAEVEKDAIPENLPPLTADFAEDKDVCKNYQEAKDAFLGSFLYEYSRRHPEYAVSVLLRLAKEYEATLEECCAKDDPHACYSTVFDKLKHLVDEPQNLIKQNCDQFEKLGEYGFQNALIVRYTRKVPQVSTPTLVEVSRSLGKVGTRCCTKPESERMPCTEDYLSLILNRLCVLHEKTPVSEKVTKCCTESLVNRRPCFSALTPDETYVPKAFDEKLFTFHADICTLPDTEKQIKKQTALVELLKHKPKATEEQLKTVMENFVAFVDKCCAADDKEACFAVEGPKLVVSTQTALA

SEQ ID NO: 12 - protein, 607 aa, Equus caballus
MKWVTFVSLLFLFSSAYSRGVLRRDTHKSEIAHRFNDLGEKHFKGLVLVAFSQYLQQCPFEDHVKLVNEVTEFAKKCAADESAENCDKSLHTLFGDKLCTVATLRATYGELADCCEKQEPERNECFLTHKDDHPNLPKLKPEPDAQCAAFQEDPDKFLGKYLYEVARRHPYFYGPELLFHAEEYKADFTECCPADDKLACLIPKLDALKERILLSSAKERLKCSSFQNFGERAVKAWSVARLSQKFPKADFAEVSKIVTDLTKVHKECCHGDLLECADDRADLAKYICEHQDSISGKLKACCDKPLLQKSHCIAEVKEDDLPSDLPALAADFAEDKEICKHYKDAKDVFLGTFLYEYSRRHPDYSVSLLLRIAKTYEATLEKCCAEADPPACYRTVFDQFTPLVEEPKSLVKKNCDLFEEVGEYDFQNALIVRYTKKAPQVSTPTLVEIGRTLGKVGSRCCKLPESERLPCSENHLALALNRLCVLHEKTPVSEKITKCCTDSLAERRPCFSALELDEGYVPKEFKAETFTFHADICTLPEDEKQIKKQSALAELVKHKPKATKEQLKTVLGNFSAFVAKCCGREDKEACFAEEGPKLVASSQLALA

SEQ ID NO: 13 - protein, 607 aa, Equus asinus
MKWVTFVSLLFLFSSAYFRGVLRRDTHKSEIAHRFNDLGEKHFKGLVLVAFSQYLQQCPFEDHVKLVNEVTEFAKKCAADESAENCDKSLHTLFGDKLCTVATLRATYGELADCCEKQEPERNECFLTHKDDHPNLPKLKPEPDAQCAAFQEDPDKFLGKYLYEVARRHPYFYGPELLFHAEEYKADFTECCPADDKAGCLIPKLDALKERILLSSAKERLKCSSFQKFGERAFKAWSVARLSQKFPKADFAEVSKIVTDLTKVHKECCHGDLLECADDRADLTKYICEHQDSISGKLKACCDKPLLQKSHCIAEVKEDDLPSDLPALAADFAEDKEICKHYKDAKDVFLGTFLYEYSRRHPDYSVSLLLRIAKTYEATLEKCCAEADPPACYATVFDQFTPLVEEPKSLVKKNCDLFEEVGEYDFQNALIVRYTKKAPQVSTPTLVEIGRTLGKVGSRCCKLPESERLPCSENHLALALNRLCVLHEKTPVSEKITKCCTDSLAERRPCFSALELDEGYIPKEFKAETFTFHADICTLPEDEKQIKKQSALAELVKHKPKATKEQLKTVLGNFSAFVAKCCGAEDKEACFAEEGPKLVASSQLALA

SEQ ID NO: 14 - protein, 608 aa, Oryctolagus cuniculus
MKWVTFISLLFLFSSAYSRGVFRREAHKSEIAHRFNDVGEEHFIGLVLITFSQYLQKCPYEEHAKLVKEVTDLAKACVADESAANCDKSLHDIFGDKICALPSLRDTYGDVADCCEKKEPERNECFLHHKDDKPDLPPFARPEADVLCKAFHDDEKAFFGHYLYEVARRHPYFYAPELLYYAQKYKAILTECCEAADKGACLTPKLDALEGKSLISAAQERLRCASIQKFGDRAYKAWALVRLSQRFPKADFTDISKIVTDLTKVHKECCHGDLLECADDRADLAKYMCEHQETISSHLKECCDKPILEKAHCIYGLHNDETPAGLPAVAEEFVEDKDVCKNYEEAKDLFLGKFLYEYSRRHPDYSVVLLLRLGKAYEATLKKCCATDDPHACYAKVLDEFQPLVDEPKNLVKQNCELYEQLGDYNFQNALLVRYTKKVPQVSTPTLVEISRSLGKVGSKCCKHPEAERLPCVEDYLSVVLNRLCVLHEKTPVSEKVTKCCSESLVDRRPCFSALGPDETYVPKEFNAETFTFHADICTLPETERKIKKQTALVELVKHKPHATNDQLKTVVGEFTALLDKCCSAEDKEACFAVEGPKLVESSKATLG

SEQ ID NO: 15 - protein, 583 aa, Capra hircus
DTHKSEIAHRFNDLGEENFQGLVLIAFSQYLQQCPFDEHVKLVKELTEFAKTCVADESHAGCDKSLHTLFGDELCKVATLRETYGDMADCCEKQEPERNECFLKHKDDSPDLPKLKPEPDTLCAEFKADEKKFWGKYLYEVARRHPYFYAPELLYYANKYNGVFQECCQAEDKGACLLPKIETMREKVLASSARQRLRCASIQKFGERALKAWSVARLSQKFPKADFTDVTKIVTDLTKVHKECCHGDLLECADDRADLAKYICDHQDTLSSKLKECCDKPVLEKSHCIAEIDKDAVPENLPPLTADFAEDKEVCKNYQEAKDVFLGSFLYEYSRRHPEYAVSVLLRLAKEYEATLEDCCAKEDPHACYATVFDKLKHLVDEPQNLIKKNCELFEKHGEYGFQNALIVRYTRKAPQVSTPTLVEISRSLGKVGTKCCAKPESERMPCTEDYLSLILNRLCVLHEKTPVSEKVTKCCTESLVNRRPCFSDLTLDETYVPKPFDGESFTFHADICTLPDTEKQIKKQTALVELLKHKPKATDEQLKTVMENFVAFVDKCCAADDKEGCFLLEGPKLVASTQAALA

SEQ ID NO: 16 - protein, 607 aa, Ovis aries
MKWVTFISLLLLFSSAYSRGVFRRDTHKSEIAHRFNDLGEENFQGLVLIAFSQYLQQCPFDEHVKLVKELTEFAKTCVADESHAGCDKSLHTLFGDELCKVATLRETYGDMADCCEKQEPERNECFLNHKDDSPDLPKLKPEPDTLCAEFKADEKKFWGKYLYEVARRHPYFYAPELLYYANKYNGVFQECCQAEDKGACLLPKIDAMREKVLASSARQRLRCASIQKFGERALKAWSVARLSQKFPKADFTDVTKIVTDLTKVHKECCHGDLLECADDRADLAKYICDHQDALSSKLKECCDKPVLEKSHCIAEVDKDAVPENLPPLTADFAEDKEVCKNYQEAKDVFLGSFLYEYSRRHPEYAVSVLLRLAKEYEATLEDCCAKEDPHACYATVFDKLKHLVDEPQNLIKKNCELFEKHGEYGFQNALIVRYTRKAPQVSTPTLVEISRSLGKVGTKCCAKPESERMPCTEDYLSLILNRLCVLHEKTPVSEKVTKCCTESLVNRRPCFSDLTLDETYVPKPFDEKFFTFHADICTLPDTEKQIKKQTALVELLKHKPKATDEQLKTVMENFVAFVDKCCAADDKEGCFVLEGPKLVASTQAALA

SEQ ID NO: 17 - protein, 608 aa, canis lupus familiaris
MKWVTFISLFFLFSSAYSRGLVRREAYKSEIAHRYNDLGEEHFRGLVLVAFSQYLQQCPFEDHVKLAKEVTEFAKACAAEESGANCDKSLHTLFGDKLCTVASLRDKYGDMADCCEKQEPDRNECFLAHKDDNPGFPPLVAPEPDALCAAFQDNEQLFLGKYLYEIARRHPYFYAPELLYYAQQYKGVFAECCQAADKAACLGPKIEALREKVLLSSAKERFKCASLQKFGDRAFKAWSVARLSQRFPKADFAEISKVVTDLTKVHKECCHGDLLECADDRADLAKYMCENQDSISTKLKECCDKPVLEKSQCLAEVERDELPGDLPSLAADFVEDKEVCKNYQEAKDVFLGTFLYEYARRHPEYSVSLLLRLAKEYEATLEKCCATDDPPTCYAKVLDEFKPLVDEPQNLVKTNCELFEKLGEYGFQNALLVRYTKKAPQVSTPTLVEVSRKLGKVGTKCCKKPESERMSCAEDFLSVVLNRLCVLHEKTPVSERVTKCCSESLVNRRPCFSGLEVDETYVPKEFNAETFTFHADLCTLPEAEKQVKKQTALVELLKHKPKATDEQLKTVMGDFGAFVEKCCAAENKEGCFSEEGPKLVAAAQAALV

SEQ ID NO: 18 - protein, 615 aa, Gallus gallus
MKWVTLISFIFLFSSATSRNLQRFARDAEHKSEIAHRYNDLKEETFKAVAMITFAQYLQRCSYEGLSKLVKDVVDLAQKCVANEDAPECSKPLPSIILDEICQVEKLRDSYGAMADCCSKADPERNECFLSFKVSQPDFVQPYQRPASDVICQEYQDNRVSFLGHFIYSVARRHPFLYAPAILSFAVDFEHALQSCCKESDVGACLDTKEIVMREKAKGVSVKQQYFCGILKQFGDRVFQARQLIYLSQKYPKAPFSEVSKFVHDSIGVHKECCEGDMVECMDDMARMMSNLCSQQDVFSGKIKDCCEKPIVERSQCIMEAEFDEKPADLPSLVEKYIEDKEVCKSFEAGHDAFMAEFVYEYSRRHPEFSIQLIMRIAKGYESLLEKCCKTDNPAECYANAQEQLNQHIKETQDVVKTNCDLLHDHGEADFLKSILIRYTKKMPQVPTDLLLETGKKMTTIGTKCCQLGEDRRMACSEGYLSIVIHDTCRKQETTPINDNVSQCCSQLYANRRPCFTAMGVDTKYVPPPFNPDMFSFDEKLCSAPAEEREVGQMKLLINLIKRKPQMTEEQIKTIADGFTAMVDKCCKQSDINTCFGEEGANLIVQSRATLGIGA

SEQ ID NO: 19 - protein, 607 aa, Sus scrofa
MKWVTFISLLFLFSSAYSRGVFRRDTYKSEIAHRFKDLGEQYFKGLVLIAFSQHLQQCPYEEHVKLVREVTEFAKTCVADESAENCDKSIHTLFGDKLCAIPSLREHYGDLADCCEKEEPERNECFLQHKNDNPDIPKLKPDPVALCADFQEDEQKFWGKYLYEIARRHPYFYAPELLYYAIIYKDVFSECCQAADKAACLLPKIEHLREKVLTSAAKQRLKCASIQKFGERAFKAWSLARLSQRFPKADFTEISKIVTDLAKVHKECCHGDLLECADDRADLAKYICENQDTISTKLKECCDKPLLEKSHCIAEAKRDELPADLNPLEHDFVEDKEVCKNYKEAKHVFLGTFLYEYSRRHPDYSVSLLLRIAKIYEATLEDCCAKEDPPACYATVFDKFQPLVDEPKNLIKQNCELFEKLGEYGFQNALIVRYTKKVPQVSTPTLVEVARKLGLVGSRCCKRPEEERLSCAEDYLSLVLNRLCVLHEKTPVSEKVTKCCTESLVNRRPCFSALTPDETYKPKEFVEGTFTFHADLCTLPEDEKQIKKQTALVELLKHKPHATEEQLRTVLGNFAAFVQKCCAAPDHEACFAVEGPKFVIEIRGILA

SEQ ID NO: 20 - protein, 584 aa, artificial sequence
  N terminal is residues 1 to 572 of HSA. C terminal is residues 573 to 584 of Macaque albumin.
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKFVAASQAALA

SEQ ID NO: 21 - protein, 584 aa, Artificial Sequence
  N terminal is residues 1 to 572 from HSA. C terminal is residues 573 to 584 from mouse albumin.
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPNLVTRCKDALA

SEQ ID NO: 22 - protein, 584 aa, Artificial Sequence
  N terminal is residues 1 to 572 of HSA. C terminal is residues 573 to 584 of rabbit albumin.
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVESSKATLG

SEQ ID NO: 23 - protein, 584 aa, Artificial Sequence
  N-terminal is residues 1 to 572 of HSA. C-terminal is residues 573 to 583 of sheep albumin.
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVASTQAALA

SEQ ID NO: 24 - protein, 399 aa, Artificial sequence
  Artificial albumin variant: human serum albumin domain 1 and human serum albumin domain 3
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 25 - protein, 403 aa, Artificial sequence
  Artificial albumin variant: human serum albumin domain 2 and human serum albumin domain 3
DELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 26 - protein, 410 aa, Artificial sequence
  Artificial albumin variant: two consecutive copies of human serum albumin domain 3
VEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 27 - protein, 205 aa, Artificial sequence [sequence omitted]

SEQ ID NO: 28 - protein, 615 aa, Artificial Sequence
  HSA Domain III + HSA Domain III + HSA Domain III
VEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 29 - protein, 604 aa, Artificial Sequence
  HSA Domain I + HSA Domain III + HSA Domain III
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 30 - protein, 290 aa, Homo sapiens
  misc_feature (1)..(290): Truncated heavy chain of the major histocompatibility complex class I-like Fc receptor (FCGRT) (together, SEQ ID No. 30 and SEQ ID No. 31 form FcRN)
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVEL

SEQ ID NO: 31 - protein, 119 aa, Homo sapiens
  misc_feature (1)..(119): Beta-2-microglobulin (together, SEQ ID No. 30 and SEQ ID No. 31 form FcRN)
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 32 - protein, 585 aa, Artificial sequence
  HSA E49A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALLVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 33 - protein, 585 aa, Artificial sequence
  HSA E492C
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALCVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 34 - protein, 585 aa, Artificial sequence
  HSA E492D
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 35 - protein, 585 aa, Artificial sequence
  HSA E492F
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALFVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 36 - protein, 585 aa, Artificial sequence
  HSA E492G
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 37 - protein, 585 aa, Artificial sequence
  HSA E492H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALHVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 38 - protein, 585 aa, Artificial sequence
  HSA E492I
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALIVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 39 - protein, 585 aa, Artificial sequence
  HSA E492K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALKVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 40 - protein, 585 aa, Artificial sequence; identical to SEQ ID NO: 32
  HSA E492L

SEQ ID NO: 41 - protein, 585 aa, Artificial sequence
  E492M
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALMVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 42 - protein, 585 aa, Artificial sequence
  HSA E492N
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALNVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 43 - protein, 585 aa, Artificial sequence
  HSA E492P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALPVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 44 - protein, 585 aa, Artificial sequence
  HSA E492Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALQVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 45 - protein, 585 aa, Artificial sequence
  HSA E492R
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALRVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 46 - protein, 585 aa, Artificial sequence
  HSA E492S
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALSVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 47 - protein, 585 aa, Artificial sequence
  HSA E492T
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALTVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 48 - protein, 585 aa, Artificial sequence
  HSA E492V
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALVVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 49 - protein, 585 aa, Artificial sequence
  HSA E492W
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALWVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 50 - protein, 585 aa, Artificial sequence
  HSA E492Y
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALYVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 51 - protein, 585 aa, Artificial sequence
  HSA D550A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDAFAAFVEKCCKADDKETCFAEEGKKLVAASQAALGL

SEQ ID NO: 52 - protein, 585 aa, Artificial sequence
  HSA D550C
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDCFAAFVEKCCKADDKETCFAEEGKKLVAASQAALGL

SEQ ID NO: 53 - protein, 585 aa, Artificial sequence
  HSA D550E
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDEFAAFVEKCCKADDKETCFAEEGKKLVAASQAALGL

SEQ ID NO: 54 - protein, 585 aa, Artificial sequence
  HSA D550F
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDFFAAFVEKCCKADDKETCFAEEGKKLVAASQAALGL

SEQ ID NO: 55 - protein, 585 aa, Artificial sequence
  HSA D550G
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDGFAAFVEKCCKADDKETCFAEEGKKLVAASQAALGL

SEQ ID NO: 56 - protein, 585 aa, Artificial sequence
  HSA D550H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDHFAAFVEKCCKADDKETCFAEEGKKLVAASQAALGL

SEQ ID NO: 57 - protein, 585 aa, Artificial sequence
  HSA D550I
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDIFAAFVEKCCKADDKETCFAEEGKKLVAASQAALGL

SEQ ID NO: 58 - protein, 585 aa, Artificial sequence
  HSA D550K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGKKLVAASQAALGL

SEQ ID NO: 59 - protein, 585 aa, Artificial sequence
  HSA D550L
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDLFAAFVEKCCKADDKETCFAEEGKKLVAASQAALGL

SEQ ID NO: 60 - protein, 585 aa, Artificial sequence
  HSA D550M
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDMFAAFVEKCCKADDKETCFAEEGKKLVAASQAALGL

SEQ ID NO: 61 - protein, 585 aa, Artificial sequence
  HSA D550N
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDNFAAFVEKCCKADDKETCFAEEGKKLVAASQAALGL

SEQ ID NO: 62 - protein, 585 aa, Artificial sequence
  HSA D550P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDPFAAFVEKCCKADDKETCFAEEGKKLVAASQAALGL

SEQ ID NO: 63 - protein, 585 aa, Artificial sequence
  HSA D550Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDQFAAFVEKCCKADDKETCFAEEGKKLVAASQAALGL

SEQ ID NO: 64 - protein, 585 aa, Artificial sequence
  HSA D550R
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDRFAAFVEKCCKADDKETCFAEEGKKLVAASQAALGL

SEQ ID NO: 65 - protein, 585 aa, Artificial sequence
  HSA D550S
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDSFAAFVEKCCKADDKETCFAEEGKKLVAASQAALGL

SEQ ID NO: 66 - protein, 585 aa, Artificial sequence
  HSA D550T
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDTFAAFVEKCCKADDKETCFAEEGKKLVAASQAALGL

SEQ ID NO: 67 - protein, 585 aa, Artificial sequence
  HSA D550V
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDVFAAFVEKCCKADDKETCFAEEGKKLVAASQAALGL

SEQ ID NO: 68 - protein, 585 aa, Artificial sequence
  HSA D550Y
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDYFAAFVEKCCKADDKETCFAEEGKKLVAASQAALGL

SEQ ID NO: 69 - protein, 585 aa, Artificial sequence
  HSA D550W
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDWFAAFVEKCCKADDKETCFAEEGKKLVAASQAALGL

SEQ ID NO: 70 - protein, 585 aa, Artificial sequence
  HSA K574A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKALVAASQAALGL

SEQ ID NO: 71 - protein, 585 aa, Artificial sequence
  HSA K574C
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKCLVAASQAALGL

SEQ ID NO: 72 - protein, 585 aa, Artificial sequence
  HSA K574D
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKDLVAASQAALGL

SEQ ID NO: 73 - protein, 585 aa, Artificial sequence
  HSA K574E
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKELVAASQAALGL

SEQ ID NO: 74 - protein, 585 aa, Artificial sequence
  HSA K574F
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKFLVAASQAALGL

SEQ ID NO: 75 - protein, 585 aa, Artificial sequence
  HSA K574G
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKGLVAASQAALGL

SEQ ID NO: 76 - protein, 585 aa, Artificial sequence
  HSA K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKHLVAASQAALGL

SEQ ID NO: 77 - protein, 585 aa, Artificial sequence
  HSA K574I
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKILVAASQAALGL

SEQ ID NO: 78 - protein, 585 aa, Artificial sequence
  HSA K574L
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKLLVAASQAALGL

SEQ ID NO: 79 - protein, 585 aa, Artificial sequence
  HSA K574M
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKMLVAASQAALGL

SEQ ID NO: 80 - protein, 585 aa, Artificial sequence
  HSA K574N
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKNLVAASQAALGL

SEQ ID NO: 81 - protein, 585 aa, Artificial sequence
  HSA K574P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKPLVAASQAALGL

SEQ ID NO: 82 - protein, 585 aa, Artificial sequence
  HSA K574Q
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKQLVAASQAALGL

SEQ ID NO: 83 - protein, 585 aa, Artificial sequence
  HSA K574R
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKRLVAASQAALGL

SEQ ID NO: 84 - protein, 585 aa, Artificial sequence
  HSA K574S
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKSLVAASQAALGL

SEQ ID NO: 85 - protein, 585 aa, Artificial sequence
  HSA K574T
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKTLVAASQAALGL

SEQ ID NO: 86 - protein, 585 aa, Artificial sequence
  HSA K574V
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKVLVAASQAALGL

SEQ ID NO: 87 - protein, 585 aa, Artificial sequence
  HSA K574Y
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKYLVAASQAALGL

SEQ ID NO: 88 - protein, 585 aa, Artificial sequence
  HSA K574W
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKWLVAASQAALGL

SEQ ID NO: 89 - protein, 585 aa, Artificial sequence
  HSA Q580A
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASAAALGL

SEQ ID NO: 90 - protein, 585 aa, Artificial sequence
  HSA Q580C
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASCAALGL

SEQ ID NO: 91 - protein, 585 aa, Artificial sequence
  HSA Q580D
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASDAALGL

SEQ ID NO: 92 - protein, 585 aa, Artificial sequence
  HSA Q580E
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASEAALGL

SEQ ID NO: 93 - protein, 585 aa, Artificial sequence
  HSA Q580F
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASFAALGL

SEQ ID NO: 94 - protein, 585 aa, Artificial sequence
  HSA Q580G
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASGAALGL

SEQ ID NO: 95 - protein, 585 aa, Artificial sequence
  HSA Q580H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASHAALGL

SEQ ID NO: 96 - protein, 585 aa, Artificial sequence
  HSA Q580I
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASIAALGL

SEQ ID NO: 97 - protein, 585 aa, Artificial sequence
  HSA Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASKAALGL

SEQ ID NO: 98 - protein, 585 aa, Artificial sequence
  HSA Q580L
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASLAALGL

SEQ ID NO: 99 - protein, 585 aa, Artificial sequence
  HSA Q580M
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASMAALGL

SEQ ID NO: 100 - protein, 585 aa, Artificial sequence
  HSA Q580N
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASNAALGL

SEQ ID NO: 101 - protein, 585 aa, Artificial sequence
  HSA Q580P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASPAALGL

SEQ ID NO: 102 - protein, 585 aa, Artificial sequence
  HSA Q580R
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASRAALGL

SEQ ID NO: 103 - protein, 585 aa, Artificial sequence
  HSA Q580S
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASSAALGL

SEQ ID NO: 104 - protein, 585 aa, Artificial sequence
  HSA Q580T
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASTAALGL

SEQ ID NO: 105 - protein, 585 aa, Artificial sequence
  HSA Q580V
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASVAALGL

SEQ ID NO: 106 - protein, 585 aa, Artificial sequence
  HSA Q580Y
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASYAALGL

SEQ ID NO: 107 - protein, 585 aa, Artificial sequence
  HSA Q580W
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASWAALGL

SEQ ID NO: 108 - protein, 585 aa, Artificial sequence
  HSA E492D+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 109 - protein, 585 aa, Artificial sequence
  HSA E492F+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALFVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 110 - protein, 585 aa, Artificial sequence
  HSA E492G+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 111 - protein, 585 aa, Artificial sequence
  HSA E492H+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALHVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 112 - protein, 585 aa, Artificial sequence
  HSA E492M+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALMVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 113 - protein, 585 aa, Artificial sequence
  HSA E492R+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALRVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 114 - protein, 585 aa, Artificial sequence
  HSA E492D+K573P+K574H+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 115 - protein, 585 aa, Artificial sequence
  HSA E492G+K573P+K574H+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 116 - protein, 585 aa, Artificial sequence
  HSA D550E+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDEFAAFVEKCCKADDKETCFAEEGPKLVAASQAALGL

SEQ ID NO: 117 - protein, 585 aa, Artificial sequence
  HSA D550K+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 118 - protein, 585 aa, Artificial sequence
  HSA D550L+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDLFAAFVEKCCKADDKETCFAEEGPKLVAASQAALGL

SEQ ID NO: 119 - protein, 585 aa, Artificial sequence
  HSA D550M+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDMFAAFVEKCCKADDKETCFAEEGPKLVAASQAALGL

SEQ ID NO: 120 - protein, 585 aa, Artificial sequence
  HSA D550R+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDRFAAFVEKCCKADDKETCFAEEGPKLVAASQAALGL

SEQ ID NO: 121 - protein, 585 aa, Artificial sequence
  HSA k574D+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPDLVAASQAALGL

SEQ ID NO: 122 - protein, 585 aa, Artificial sequence
  HSA K574F+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPFLVAASQAALGL

SEQ ID NO: 123 - protein, 585 aa, Artificial sequence
  HSA K574G+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPGLVAASQAALGL

SEQ ID NO: 124 - protein, 585 aa, Artificial sequence
  HSA K574H+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASQAALGL

SEQ ID NO: 125 - protein, 585 aa, Artificial sequence
  HSA K574N+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPNLVAASQAALGL

SEQ ID NO: 126 - protein, 585 aa, Artificial sequence
  HSA K574S+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPSLVAASQAALGL

SEQ ID NO: 127 - protein, 585 aa, Artificial sequence
  HSA K574Y+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPYLVAASQAALGL

SEQ ID NO: 128 - protein, 585 aa, Artificial sequence
  HSA Q580K+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 129 - protein, 585 aa, Artificial sequence
  HSA Q580R+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASRAALGL

SEQ ID NO: 130 - protein, 585 aa, Artificial sequence
  HSA D550K+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGKHLVAASQAALGL

SEQ ID NO: 131 - protein, 585 aa, Artificial sequence
  HSA D550K+K574H+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 132 - protein, 585 aa, Artificial sequence
  HSA D550K+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGKKLVAASKAALGL

SEQ ID NO: 133 - protein, 585 aa, Artificial sequence
  HSA D550K+Q580K+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 134 - protein, 585 aa, Artificial sequence
  HSA K574H+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKHLVAASKAALGL

SEQ ID NO: 135 - protein, 585 aa, Artificial sequence
  HSA K574H+Q580K+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 136 - DNA, 49 bp, Artificial sequence
  Oligonucleotide primer HSA-1
gaagaccatgtttctctgctttggctgtcgacgaaacttacgttccaaa

SEQ ID NO: 137 - DNA, 49 bp, Artificial sequence
  Oligonucleotide primer HSA-2
gaagaccatgtttctctgctttgtgtgtcgacgaaacttacgttccaaa

SEQ ID NO: 138 - DNA, 49 bp, Artificial sequence
  Oligonucleotide primer HSA-3
gaagaccatgtttctctgctttggatgtcgacgaaacttacgttccaaa

SEQ ID NO: 139 - DNA, 49 bp, Artificial sequence
  Oligonucleotide primer HSA-4
gaagaccatgtttctctgctttgtttgtcgacgaaacttacgttccaaa

SEQ ID NO: 140 - DNA, 49 bp, Artificial sequence
  Oligonucleotide primer HSA-5
gaagaccatgtttctctgctttgggtgtcgacgaaacttacgttccaaa

SEQ ID NO: 141 - DNA, 49 bp, Artificial sequence
  Oligonucleotide primer HSA-6
gaagaccatgtttctctgctttgcatgtcgacgaaacttacgttccaaa

SEQ ID NO: 142 - DNA, 49 bp, Artificial sequence
  Oligonucleotide primer HSA-7
gaagaccatgtttctctgctttgattgtcgacgaaacttacgttccaaa

SEQ ID NO: 143 - DNA, 49 bp, Artificial sequence
  Oligonucleotide primer HSA-8
gaagaccatgtttctctgctttgaaagtcgacgaaacttacgttccaaa

SEQ ID NO: 144 - DNA, 49 bp, Artificial sequence
  Oligonucleotide primer HSA-9
gaagaccatgtttctctgctttgttggtcgacgaaacttacgttccaaa

SEQ ID NO: 145 - DNA, 49 bp, Artificial sequence
  Oligonucleotide primer HSA-10
gaagaccatgtttctctgctttgatggtcgacgaaacttacgttccaaa

SEQ ID NO: 146 - DNA, 49 bp, Artificial sequence
  Oligonucleotide primer HSA-11
gaagaccatgtttctctgctttgaatgtcgacgaaacttacgttccaaa

SEQ ID NO: 147 - DNA, 49 bp, Artificial sequence
  Oligonucleotide primer HSA-12
gaagaccatgtttctctgctttgccagtcgacgaaacttacgttccaaa

SEQ ID NO: 148 - DNA, 49 bp, Artificial sequence
  Oligonucleotide primer HSA-13
gaagaccatgtttctctgctttgcaagtcgacgaaacttacgttccaaa

SEQ ID NO: 149 - DNA, 49 bp, Artificial sequence
  Oligonucleotide primer HSA-14
gaagaccatgtttctctgctttgagagtcgacgaaacttacgttccaaa

SEQ ID NO: 150 - DNA, 49 bp, Artificial sequence
  Oligonucleotide primer HSA-15
gaagaccatgtttctctgctttgtctgtcgacgaaacttacgttccaaa

SEQ ID NO: 151 - DNA, 49 bp, Artificial sequence
  Oligonucleotide primer HSA-16
gaagaccatgtttctctgctttgactgtcgacgaaacttacgttccaaa

SEQ ID NO: 152 - DNA, 49 bp, Artificial sequence
  Oligonucleotide primer HSA-17
gaagaccatgtttctctgctttggttgtcgacgaaacttacgttccaaa

SEQ ID NO: 153 - DNA, 49 bp, Artificial sequence
  Oligonucleotide primer HSA-18
gaagaccatgtttctctgctttgtatgtcgacgaaacttacgttccaaa

SEQ ID NO: 154 - DNA, 49 bp, Artificial sequence
  Oligonucleotide primer HSA-19
gaagaccatgtttctctgctttgtgggtcgacgaaacttacgttccaaa

SEQ ID NO: 155 - DNA, 50 bp, Artificial sequence
  Oligonucleotide primer HSA-20
gaacaattgaaggctgtcatggatgctttcgctgctttcgttgaaaagtg

SEQ ID NO: 156 - DNA, 50 bp, Artificial sequence
  Oligonucleotide primer HSA-21
gaacaattgaaggctgtcatggattgtttcgctgctttcgttgaaaagtg

SEQ ID NO: 157 - DNA, 50 bp, Artificial sequence
  Oligonucleotide primer HSA-22
gaacaattgaaggctgtcatggatgaattcgctgctttcgttgaaaagtg

SEQ ID NO: 158 - DNA, 50 bp, Artificial sequence
  Oligonucleotide primer HSA-23
gaacaattgaaggctgtcatggattttttcgctgctttcgttgaaaagtg

SEQ ID NO: 159 - DNA, 50 bp, Artificial sequence
  Oligonucleotide primer HSA-24
gaacaattgaaggctgtcatggatggtttcgctgctttcgttgaaaagtg

SEQ ID NO: 160 - DNA, 50 bp, Artificial sequence
  Oligonucleotide primer HSA-25
gaacaattgaaggctgtcatggatcatttcgctgctttcgttgaaaagtg

SEQ ID NO: 161 - DNA, 50 bp, Artificial sequence
  Oligonucleotide primer HSA-26
gaacaattgaaggctgtcatggatattttcgctgctttcgttgaaaagtg

SEQ ID NO: 162 - DNA, 50 bp, Artificial sequence
  Oligonucleotide primer HSA-27
gaacaattgaaggctgtcatggataaattcgctgctttcgttgaaaagtg

SEQ ID NO: 163 - DNA, 50 bp, Artificial sequence
  Oligonucleotide primer HSA-28
gaacaattgaaggctgtcatggatttgttcgctgctttcgttgaaaagtg

SEQ ID NO: 164 - DNA, 50 bp, Artificial sequence
  Oligonucleotide primer HSA-29
gaacaattgaaggctgtcatggatatgttcgctgctttcgttgaaaagtg

SEQ ID NO: 165 - DNA, 50 bp, Artificial sequence
  Oligonucleotide primer HSA-30
gaacaattgaaggctgtcatggataatttcgctgctttcgttgaaaagtg

SEQ ID NO: 166 - DNA, 50 bp, Artificial sequence
  Oligonucleotide primer HSA-31
gaacaattgaaggctgtcatggatccattcgctgctttcgttgaaaagtg

SEQ ID NO: 167 - DNA, 50 bp, Artificial sequence
  Oligonucleotide primer HSA-32
gaacaattgaaggctgtcatggatcaattcgctgctttcgttgaaaagtg

SEQ ID NO: 168 - DNA, 50 bp, Artificial sequence
  Oligonucleotide primer HSA-33
gaacaattgaaggctgtcatggatagattcgctgctttcgttgaaaagtg

SEQ ID NO: 169 - DNA, 50 bp, Artificial sequence
  Oligonucleotide primer HSA-34
gaacaattgaaggctgtcatggattctttcgctgctttcgttgaaaagtg

SEQ ID NO: 170 - DNA, 50 bp, Artificial sequence
  Oligonucleotide primer HSA-35
gaacaattgaaggctgtcatggatactttcgctgctttcgttgaaaagtg

SEQ ID NO: 171 - DNA, 50 bp, Artificial sequence
  Oligonucleotide primer HSA-36
gaacaattgaaggctgtcatggatgttttcgctgctttcgttgaaaagtg

SEQ ID NO: 172 - DNA, 50 bp, Artificial sequence
  Oligonucleotide primer HSA-37
gaacaattgaaggctgtcatggattatttcgctgctttcgttgaaaagtg

SEQ ID NO: 173 - DNA, 50 bp, Artificial sequence
  Oligonucleotide primer HSA-38
gaacaattgaaggctgtcatggattggttcgctgctttcgttgaaaagtg

SEQ ID NO: 174 - DNA, 47 bp, Artificial sequence
  Oligonucleotide primer HSA-39
cttgtttcgctgaagaaggtaaggctttggtcgctgcttcccaagct

SEQ ID NO: 175 - DNA, 47 bp, Artificial sequence
  Oligonucleotide primer HSA-40
cttgtttcgctgaagaaggtaagtgtttggtcgctgcttcccaagct

SEQ ID NO: 176 - DNA, 47 bp, Artificial sequence
  Oligonucleotide primer HSA-41
cttgtttcgctgaagaaggtaaggatttggtcgctgcttcccaagct

SEQ ID NO: 177 - DNA, 47 bp, Artificial sequence
  Oligonucleotide primer HSA-42
cttgtttcgctgaagaaggtaaggaattggtcgctgcttcccaagct

SEQ ID NO: 178 - DNA, 47 bp, Artificial sequence
  Oligonucleotide primer HSA-43
cttgtttcgctgaagaaggtaagtttttggtcgctgcttcccaagct

SEQ ID NO: 179 - DNA, 47 bp, Artificial sequence
  Oligonucleotide primer HSA-44
cttgtttcgctgaagaaggtaagggtttggtcgctgcttcccaagct

SEQ ID NO: 180 - DNA, 47 bp, Artificial sequence
  Oligonucleotide primer HSA-45
cttgtttcgctgaagaaggtaagcatttggtcgctgcttcccaagct

SEQ ID NO: 181 - DNA, 47 bp, Artificial sequence
  Oligonucleotide primer HSA-46
cttgtttcgctgaagaaggtaagattttggtcgctgcttcccaagct

SEQ ID NO: 182 - DNA, 47 bp, Artificial sequence
  Oligonucleotide primer HSA-47
cttgtttcgctgaagaaggtaagttgttggtcgctgcttcccaagct

SEQ ID NO: 183 - DNA, 47 bp, Artificial sequence
  Oligonucleotide primer HSA-48
cttgtttcgctgaagaaggtaagatgttggtcgctgcttcccaagct

SEQ ID NO: 184 - DNA, 47 bp, Artificial sequence
  Oligonucleotide primer HSA-49
cttgtttcgctgaagaaggtaagaatttggtcgctgcttcccaagct

SEQ ID NO: 185 - DNA, 47 bp, Artificial sequence
  Oligonucleotide primer HSA-50
cttgtttcgctgaagaaggtaagccattggtcgctgcttcccaagct

SEQ ID NO: 186 - DNA, 47 bp, Artificial sequence
  Oligonucleotide primer HSA-51
cttgtttcgctgaagaaggtaagcaattggtcgctgcttcccaagct

SEQ ID NO: 187 - DNA, 47 bp, Artificial sequence
  Oligonucleotide primer HSA-52
cttgtttcgctgaagaaggtaagagattggtcgctgcttcccaagct

SEQ ID NO: 188 - DNA, 47 bp, Artificial sequence
  Oligonucleotide primer HSA-53
cttgtttcgctgaagaaggtaagtctttggtcgctgcttcccaagct

SEQ ID NO: 189 - DNA, 47 bp, Artificial sequence
  Oligonucleotide primer HSA-54
cttgtttcgctgaagaaggtaagactttggtcgctgcttcccaagct

SEQ ID NO: 190 - DNA, 47 bp, Artificial sequence
  Oligonucleotide primer HSA-55
cttgtttcgctgaagaaggtaaggttttggtcgctgcttcccaagct

SEQ ID NO: 191 - DNA, 47 bp, Artificial sequence
  Oligonucleotide primer HSA-56
cttgtttcgctgaagaaggtaagtatttggtcgctgcttcccaagct

SEQ ID NO: 192 - DNA, 47 bp, Artificial sequence
  Oligonucleotide primer HSA-57
cttgtttcgctgaagaaggtaagtggttggtcgctgcttcccaagct

SEQ ID NO: 193 - DNA, 48 bp, Artificial sequence
  Oligonucleotide primer HSA-58
taagaagttggtcgctgcttccgctgctgccttaggtttgtaataagc

SEQ ID NO: 194 - DNA, 48 bp, Artificial sequence
  Oligonucleotide primer HSA-59
taagaagttggtcgctgcttcctgtgctgccttaggtttgtaataagc

SEQ ID NO: 195 - DNA, 48 bp, Artificial sequence
  Oligonucleotide primer HSA-60
taagaagttggtcgctgcttccgatgctgccttaggtttgtaataagc

SEQ ID NO: 196 - DNA, 48 bp, Artificial sequence
  Oligonucleotide primer HSA-61
taagaagttggtcgctgcttccgaagctgccttaggtttgtaataagc

SEQ ID NO: 197 - DNA, 48 bp, Artificial sequence
  Oligonucleotide primer HSA-62
taagaagttggtcgctgcttcctttgctgccttaggtttgtaataagc

SEQ ID NO: 198 - DNA, 48 bp, Artificial sequence
  Oligonucleotide primer HSA-63
taagaagttggtcgctgcttccggtgctgccttaggtttgtaataagc

SEQ ID NO: 199 - DNA, 48 bp, Artificial sequence
  Oligonucleotide primer HSA-64
taagaagttggtcgctgcttcccatgctgccttaggtttgtaataagc

SEQ ID NO: 200 - DNA, 48 bp, Artificial sequence
  Oligonucleotide primer HSA-65
taagaagttggtcgctgcttccattgctgccttaggtttgtaataagc

SEQ ID NO: 201 - DNA, 48 bp, Artificial sequence
  Oligonucleotide primer HSA-66
taagaagttggtcgctgcttccaaagctgccttaggtttgtaataagc

SEQ ID NO: 202 - DNA, 48 bp, Artificial sequence
  Oligonucleotide primer HSA-67
taagaagttggtcgctgcttccttggctgccttaggtttgtaataagc

SEQ ID NO: 203 - DNA, 48 bp, Artificial sequence
  Oligonucleotide primer HSA-68
taagaagttggtcgctgcttccatggctgccttaggtttgtaataagc

SEQ ID NO: 204 - DNA, 48 bp, Artificial sequence
  Oligonucleotide primer HSA-69
taagaagttggtcgctgcttccaatgctgccttaggtttgtaataagc

SEQ ID NO: 205 - DNA, 48 bp, Artificial sequence
  Oligonucleotide primer HSA-70
taagaagttggtcgctgcttccccagctgccttaggtttgtaataagc

SEQ ID NO: 206 - DNA, 48 bp, Artificial sequence
  Oligonucleotide primer HSA-71
taagaagttggtcgctgcttccagagctgccttaggtttgtaataagc

SEQ ID NO: 207 - DNA, 48 bp, Artificial sequence
  Oligonucleotide primer HSA-72
taagaagttggtcgctgcttcctctgctgccttaggtttgtaataagc

SEQ ID NO: 208 - DNA, 48 bp, Artificial sequence
  Oligonucleotide primer HSA-73
taagaagttggtcgctgcttccactgctgccttaggtttgtaataagc

SEQ ID NO: 209 - DNA, 48 bp, Artificial sequence
  Oligonucleotide primer HSA-74
taagaagttggtcgctgcttccgttgctgccttaggtttgtaataagc

SEQ ID NO: 210 - DNA, 48 bp, Artificial sequence
  Oligonucleotide primer HSA-75
taagaagttggtcgctgcttcctatgctgccttaggtttgtaataagc

SEQ ID NO: 211 - DNA, 48 bp, Artificial sequence
  Oligonucleotide primer HSA-76
taagaagttggtcgctgcttcctgggctgccttaggtttgtaataagc

SEQ ID NO: 212 - DNA, 36 bp, Artificial sequence
  Oligonucleotide primer REV E492
caaagcagagaaacatggtcttctgttaaccaaaga

SEQ ID NO: 213 - DNA, 36 bp, Artificial sequence
  Oligonucleotide primer REV D550
atccatgacagccttcaattgttccttagtagcctt

SEQ ID NO: 214 - DNA, 36 bp, Artificial sequence
  Oligonucleotide primer REV K574
cttaccttcttcagcgaaacaagtttccttatcatc

SEQ ID NO: 215 - DNA, 33 bp, Artificial sequence
  Oligonucleotide primer REV Q580
ggaagcagcgaccaacttcttaccttcttcagc

SEQ ID NO: 216 - DNA, 24 bp, Artificial sequence
  Oligonucleotide primer KBf4
ggaagtcgacgaaacttacgttcc

SEQ ID NO: 217 - DNA, 51 bp, Artificial sequence
  Oligonucleotide primer KBr30
caaacctaaggcagcttgggaagcagcgaccaactttggaccttcttcagc

SEQ ID NO: 218 - DNA, 51 bp, Artificial sequence
  Oligonucleotide primer KBr21
caaacctaaggcagcttgggaagcagcgaccaaatctggaccttcttcagc

SEQ ID NO: 219 - DNA, 51 bp, Artificial sequence
  Oligonucleotide primer KBr22
caaacctaaggcagcttgggaagcagcgaccaaaaatggaccttcttcagc

SEQ ID NO: 220 - DNA, 51 bp, Artificial sequence
  Oligonucleotide primer KBr23
caaacctaaggcagcttgggaagcagcgaccaaacctggaccttcttcagc

SEQ ID NO: 221 - DNA, 51 bp, Artificial sequence
  Oligonucleotide primer KBr24
caaacctaaggcagcttgggaagcagcgaccaaatgtggaccttcttcagc

SEQ ID NO: 222 - DNA, 42 bp, Artificial sequence
  Oligonucleotide primer KBr25
caaacctaaggcagcttgggaagcagcgaccaaatttggacc

SEQ ID NO: 223 - DNA, 51 bp, Artificial sequence
  Oligonucleotide primer KBr26
caaacctaaggcagcttgggaagcagcgaccaaagatggaccttcttcagc

SEQ ID NO: 224 - DNA, 51 bp, Artificial sequence
  Oligonucleotide primer KBr27
caaacctaaggcagcttgggaagcagcgaccaaatatggaccttcttcagc

SEQ ID NO: 225 - DNA, 42 bp, Artificial sequence
  Oligonucleotide primer KBr28
caaacctaaggcagctttggaagcagcgaccaactttggacc

SEQ ID NO: 226 - DNA, 42 bp, Artificial sequence
  Oligonucleotide primer KBr29
caaacctaaggcagctctggaagcagcgaccaactttggacc

SEQ ID NO: 227 - DNA, 51 bp, Artificial sequence
  Oligonucleotide primer KBr31
caaacctaaggcagcttgggaagcagcgaccaaatgcttaccttcttcagc

SEQ ID NO: 228 - DNA, 42 bp, Artificial sequence
  Oligonucleotide primer KBr32
caaacctaaggcagctttggaagcagcgaccaacttcttacc

SEQ ID NO: 229 - DNA, 51 bp, Artificial sequence
  Oligonucleotide primer KBr33
caaacctaaggcagctttggaagcagcgaccaaatgcttaccttcttcagc

SEQ ID NO: 230 - DNA, 51 bp, Artificial sequence
  Oligonucleotide primer KBr34
caaacctaaggcagctttggaagcagcgaccaaatgtggaccttcttcagc

SEQ ID NO: 231 - protein, 585 aa, artificial sequence
  HSA E492D+D550K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGKKLVAASQAALGL

SEQ ID NO: 232 - protein, 585 aa, artificial sequence [sequence omitted]

SEQ ID NO: 233 - protein, 585 aa, artificial sequence [sequence omitted]

SEQ ID NO: 234 - protein, 585 aa, artificial sequence
  HSA E492D+K573P+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 235 - protein, 585 aa, artificial sequence [sequence omitted]

SEQ ID NO: 236 - protein, 585 aa, artificial sequence
  HSA E492D+K573P+K574H+Q580R
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASRAALGL

SEQ ID NO: 237 - protein, 585 aa, artificial sequence [sequence omitted]

SEQ ID NO: 238 - protein, 585 aa, artificial sequence
  HSA E492F+K573P+K574G+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALFVDETYVPKEFNAETFTFHADICTLSEKERQIKKQTALVELVKHKPKATKEQLKAVMDDFAAFVEKCCKADDKETCFAEEGPGLVAASKAALGL

SEQ ID NO: 239 - protein, 585 aa, artificial sequence [sequence omitted]

SEQ ID NO: 240 - protein, 585 aa, artificial sequence [sequence omitted]

SEQ ID NO: 241 - protein, 585 aa, artificial sequence
  HSA E492G+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDDFAAFVEKCCKADDKETCFAEEGKHLVAASQAALGL

SEQ ID NO: 242 - protein, 585 aa, artificial sequence
  HSA E492G+K573P+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 243 - protein, 585 aa, artificial sequence
  HSA E492G+K573P+K574G+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDDFAAFVEKCCKADDKETCFAEEGPGLVAASKAALGL

SEQ ID NO: 244 - protein, 585 aa, artificial sequence [sequence omitted]

SEQ ID NO: 245 - protein, 585 aa, artificial sequence
  HSA D550L+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDLFAAFVEKCCKADDKETCFAEEGKHLVAASQAALGL

SEQ ID NO: 246 - protein, 585 aa, artificial sequence
  HSA D550L+K573P+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDLFAAFVEKCCKADDKETCFAEEGPHLVAASQAALGL

SEQ ID NO: 247 - protein, 585 aa, artificial sequence
  HSA D550L+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDLFAAFVEKCCKADDKETCFAEEGKKLVAASKAALGL

SEQ ID NO: 248 - protein, 585 aa, artificial sequence [sequence omitted]

SEQ ID NO: 249 - protein, 585 aa, artificial sequence
  HSA D550M+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDMFAAFVEKCCKADDKETCFAEEGKHLVAASQAALGL

SEQ ID NO: 250 - protein, 585 aa, artificial sequence
  HSA D550M+K573P+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDMFAAFVEKCCKADDKETCFAEEGPHLVAASQAALGL

SEQ ID NO: 251 - protein, 585 aa, artificial sequence
  HSA D550M+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDMFAAFVEKCCKADDKETCFAEEGKKLVAASKAALGL

SEQ ID NO: 252 - protein, 585 aa, artificial sequence
  HSA D550M+K573P+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDMFAAFVEKCCKADDKETCFAEEGPKLVAASKAALGL

SEQ ID NO: 253 - protein, 585 aa, artificial sequence
  HSA E492D+D550K+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 254 - protein, 585 aa, artificial sequence
  HSA E492G+D550K+K573P
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 255 - protein, 585 aa, artificial sequence
  HSA E492G+D550K+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGKHLVAASQAALGL

SEQ ID NO: 256 - protein, 585 aa, artificial sequence
  HSA E492D+D550K+K573P+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 257 - protein, 585 aa, artificial sequence
  HSA E492G+D550K+K573P+K574H
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 258 - protein, 585 aa, artificial sequence
  HSA E492D+D550K+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGKKLVAASKAALGL

SEQ ID NO: 259 - protein, 585 aa, artificial sequence
  HSA E492G+D550K+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGKKLVAASKAALGL

SEQ ID NO: 260 - protein, 585 aa, artificial sequence [sequence omitted]

SEQ ID NO: 261 - protein, 585 aa, artificial sequence
  HSA E492G+D550K+K573P+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 262 - protein, 585 aa, artificial sequence
  HSA E492D+K574H+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGKHLVAASKAALGL

SEQ ID NO: 263 - protein, 585 aa, artificial sequence [sequence omitted]

SEQ ID NO: 264 - protein, 585 aa, artificial sequence; identical to SEQ ID NO: 114
  HSA E492D+K573P+K574H+Q580K

SEQ ID NO: 265 - protein, 585 aa, artificial sequence
  HSA D550K+K573P+K574H+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASKAALGL

SEQ ID NO: 266 - protein, 585 aa, artificial sequence
  HSA E492D+D550K+K573P+K574H+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPHLVAASKAALGL

SEQ ID NO: 267 - protein, 585 aa, artificial sequence
  HSA E492G+D550K+K573P+K574H+Q580K
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPHLVAASKAALGL

SEQ ID NO: 268 - DNA, 48 bp, artificial sequence
  Oligonucleotide primer 01-f
gaacaattgaaggctgtcatggataagttcgctgctttcgttgaaaag

SEQ ID NO: 269 - DNA, 36 bp, artificial sequence; identical to SEQ ID NO: 213
  Oligonucleotide primer 01-r

SEQ ID NO: 270 - DNA, 44 bp, artificial sequence
  Oligonucleotide primer 02-f
cttgtttcgctgaagaaggtaagcacttggtcgctgcttcccaa

SEQ ID NO: 271 - DNA, 36 bp, artificial sequence; identical to SEQ ID NO: 214
  Oligonucleotide primer 02-r

SEQ ID NO: 272 - DNA, 46 bp, artificial sequence
  Oligonucleotide primer 03-f
taagaagttggtcgctgcttccaaggctgccttaggtttgtaataa

SEQ ID NO: 273 - DNA, 33 bp, artificial sequence; identical to SEQ ID NO: 215
  Oligonucleotide primer 03-r

SEQ ID NO: 274 - DNA, 48 bp, artificial sequence
  Oligonucleotide primer 04-f
gaaacttgtttcgctgaagaaggtccacacttggtcgctgcttcccaa

SEQ ID NO: 275 - DNA, 36 bp, artificial sequence
  Oligonucleotide primer 04-r
accttcttcagcgaaacaagtttccttatcatcagc

SEQ ID NO: 276 - DNA, 66 bp, artificial sequence
  Oligonucleotide primer 05-f
gaaacttgtttcgctgaagaaggtccaaagttggtcgctgcttccaaggctgccttaggtttgtaa

SEQ ID NO: 277 - DNA, 36 bp, artificial sequence; identical to SEQ ID NO: 275
  Oligonucleotide primer 05-r

SEQ ID NO: 278 - DNA, 66 bp, artificial sequence
  Oligonucleotide primer 06-f
gaaacttgtttcgctgaagaaggtccaggtttggtcgctgcttccaaggctgccttaggtttgtaa

SEQ ID NO: 279 - DNA, 36 bp, artificial sequence; identical to SEQ ID NO: 275
  Oligonucleotide primer 06-r

SEQ ID NO: 280 - DNA, 66 bp, artificial sequence
  Oligonucleotide primer 07-f
gaaacttgtttcgctgaagaaggtccacacttggtcgctgcttccagagctgccttaggtttgtaa

SEQ ID NO: 281 - DNA, 36 bp, artificial sequence; identical to SEQ ID NO: 275
  Oligonucleotide primer 07-r

SEQ ID NO: 282 - DNA, 66 bp, artificial sequence
  Oligonucleotide primer 08-f
gaaacttgtttcgctgaagaaggtccacacttggtcgctgcttccaaggctgccttaggtttgtaa

SEQ ID NO: 283 - DNA, 36 bp, artificial sequence; identical to SEQ ID NO: 275
  Oligonucleotide primer 08-r

SEQ ID NO: 284 - DNA, 45 bp, artificial sequence
  Oligonucleotide primer 28-f
gaagaccatgtttctctgctttggacgtcgacgaaacttacgttc

SEQ ID NO: 285 - DNA, 36 bp, artificial sequence; identical to SEQ ID NO: 212
  Oligonucleotide primer 28-r

SEQ ID NO: 286 - DNA, 45 bp, artificial sequence
  Oligonucleotide primer 29-f
gaagaccatgtttctctgctttgggtgtcgacgaaacttacgttc

SEQ ID NO: 287 - DNA, 36 bp, artificial sequence; identical to SEQ ID NO: 212
  Oligonucleotide primer 29-r

What is claimed is:

1. A method of altering the binding activity of a polypeptide, which is a variant of albumin, a fragment thereof or a fusion polypeptide comprising said variant albumin or fragment thereof, to FcRn as compared with the FcRn binding activity of a parent albumin, reference albumin, fragment thereof or a fusion polypeptide comprising said parent albumin, reference albumin or fragment or fusion thereof, comprising contacting FcRn with said polypeptide, wherein said polypeptide further comprises a substitution to K, L, or M at a position corresponding to 550 in SEQ ID NO: 2, a substitution to P, Y, W, H, F, T, I, or V at a position corresponding to 573 in SEQ ID NO: 2, and a substitution to K or R at a position corresponding to 580 in SEQ ID NO:

2, wherein said polypeptide has a stronger binding affinity to FcRn or longer plasma half-life than a parent albumin, reference albumin, fragment thereof or fusion polypeptide comprising said parent albumin, reference albumin or fragment or fusion thereof.

2. The method of claim 1, wherein within said polypeptide further comprises:
   a) a substitution to A, C, D, E, F, G, H, I, L, M, N P, Q, R, S, T, V, W, or Y at a position corresponding to position 574 of SEQ ID NO: 2; or
   b) a substitution to N at a position corresponding to position 574 of SEQ ID NO: 2, a substitution to K at a position corresponding to position 580 of SEQ ID NO: 2, and a substitution at a position corresponding to position 492 of SEQ ID NO: 2.

3. The method of claim 1, wherein within said polypeptide further comprises:
   a substitution to P at a position corresponding to position 573 of SEQ ID NO: 2, a substitution to K at a position corresponding to position 580 of SEQ ID NO: 2, and a substitution at a position corresponding to position 492 or 574 of SEQ ID NO: 2.

4. The method of claim 1, wherein within said polypeptide further comprises:
   a) a substitution to A, C, D, E, F, G, H, I, L, M, N, P, Q, R, S, T, V, W, or Y at a position corresponding to position 492 of SEQ ID NO: 2; or
   b) a substitution to N at a position corresponding to position 492 of SEQ ID NO: 2, a substitution to K at a position corresponding to position 573 of SEQ ID NO: 2, and a substitution at a position corresponding to position 574 of SEQ ID NO: 2.

5. The method of claim 1, wherein said polypeptide further comprises a substitution at one or more positions selected from positions corresponding to positions 492 and 574 in SEQ ID NO: 2.

6. The method of claim 1, wherein the reference albumin is HSA (SEQ ID NO: 2) or a fragment thereof, or a fusion polypeptide comprising HSA or a fragment thereof.

7. The method of claim 1, wherein the sequence identity of said polypeptide to SEQ ID NO: 2 is more than 80%, more than 90%, more than 95%, more than 96%, more than 97%, more than 98% or more than 99%.

8. The method of claim 1, wherein said fusion comprises a fusion partner polypeptide selected from a therapeutic, prophylactic, diagnostic, imaging or other beneficial moiety.

9. The method of claim 1, wherein said polypeptide further comprises a non-albumin moiety covalently attached to said polypeptide.

10. The method of claim 1, wherein said polypeptide further comprises a non-albumin moiety noncovalently associated with said polypeptide.

11. A method for altering the circulating half-life of a molecule comprising providing a variant of albumin, a fragment thereof or a fusion polypeptide comprising said variant albumin or fragment thereof; and
   a) where the molecule is a polypeptide, fusing or conjugating the molecule to said variant of albumin, fragment thereof or fusion polypeptide comprising said variant albumin or fragment thereof; or
   b) where the molecule is not a polypeptide, conjugating the molecule to said variant of albumin, fragment thereof or fusion polypeptide comprising said variant albumin or fragment thereof; or
   c) contacting the molecule with said variant of albumin, fragment thereof or fusion polypeptide comprising said variant albumin or fragment thereof, wherein said contacting results in a noncovalent association between said molecule and variant of albumin, fragment thereof or fusion polypeptide comprising said variant albumin or fragment thereof;
   wherein said variant of albumin, fragment thereof or fusion polypeptide comprising said variant albumin or fragment thereof comprises a substitution to K, L, or M at a position corresponding to 550 in SEQ ID NO: 2, a substitution to P, Y, W, H, F, T, I, or V at a position corresponding to 573 in SEQ ID NO: 2, and a substitution to K or R at a position corresponding to 580 in SEQ ID NO: 2, wherein said polypeptide has a stronger binding affinity to FcRn or longer plasma half-life than a parent albumin, reference albumin, fragment thereof or fusion polypeptide comprising said parent albumin, reference albumin or fragment or fusion thereof.

12. The method of claim 11, wherein within said polypeptide further comprises:
   a) a substitution to A, C, D, E, F, G, H, I, L, M, N, P, Q, R, S, T, V, W, or Y at a position corresponding to position 574 of SEQ ID NO: 2; or
   b) a substitution to N at a position corresponding to position 574 of SEQ ID NO: 2, a substitution to K at a position corresponding to position 580 of SEQ ID NO: 2, and a substitution at a position corresponding to position 492 of SEQ ID NO: 2.

13. The method of claim 11, wherein within said polypeptide further comprises:
   a substitution to P at a position corresponding to position 573 of SEQ ID NO: 2, a substitution to K at a position corresponding to position 580 of SEQ ID NO: 2, and a substitution at a position corresponding to a position selected from the group consisting of 492 and 574 of SEQ ID NO: 2.

14. The method of claim 11, wherein within said polypeptide further comprises:
   a) a substitution to A, C, D, E, F, G, H, I, L, M, N, P, Q, R, S, T, V, W, or Y at a position corresponding to position 492 of SEQ ID NO: 2; or
   b) a substitution to N at a position corresponding to position 492 of SEQ ID NO: 2, a substitution to K at a position corresponding to position 573 of SEQ ID NO: 2, and a substitution at a position corresponding to position 574 of SEQ ID NO: 2.

15. The method of claim 11, wherein said polypeptide further comprises a substitution at one or more positions selected from positions corresponding to positions 492 and 574 in SEQ ID NO: 2.

16. The method of claim 1, wherein said variant of albumin, fragment thereof or fusion polypeptide comprising said variant albumin or fragment thereof comprises a substitution to P, Y, or W at a position corresponding to 573.

17. The method of claim 1, wherein said variant of albumin, fragment thereof or fusion polypeptide comprising said variant albumin or fragment thereof comprises a substitution to P at a position corresponding to 573.

18. The method of claim 1, wherein said variant of albumin, fragment thereof or fusion polypeptide comprising said variant albumin or fragment thereof comprises a substitution to L at a position corresponding to 550, a substitution to P at a position corresponding to 573, and a substitution to K at a position corresponding to 580.

19. The method of claim 11, wherein said variant of albumin, fragment thereof or fusion polypeptide comprising said variant albumin or fragment thereof comprises a substitution to P, Y, or W at a position corresponding to 573.

20. The method of claim 11, wherein said variant of albumin, fragment thereof or fusion polypeptide comprising said variant albumin or fragment thereof comprises a substitution to P at a position corresponding to 573.

21. The method of claim 11, wherein said variant of albumin, fragment thereof or fusion polypeptide comprising said variant albumin or fragment thereof comprises a substitution to L at a position corresponding to 550, a substitution to P at a position corresponding to 573, and a substitution to K at a position corresponding to 580.

22. The method of claim 1, wherein said variant of albumin, fragment thereof or fusion polypeptides comprising said variant albumin or fragment thereof comprises a substitution to M at a position corresponding to position 550 of SEQ ID NO: 2, a substitution to P at a position corresponding to position 573 of SEQ ID NO: 2, and a substitution to K at a position corresponding to position 580 of SEQ ID NO: 2.

23. The method of claim 1, wherein said variant of albumin, fragment thereof or fusion polypeptides comprising said variant albumin or fragment thereof comprises a substitution to K at a position corresponding to position 550 of SEQ ID NO: 2, a substitution to P at a position corresponding to position 573 of SEQ ID NO: 2, and a substitution to K at a position corresponding to position 580 of SEQ ID NO: 2.

24. The method of claim 11, wherein said variant of albumin, fragment thereof or fusion polypeptides comprising said variant albumin or fragment thereof comprises a substitution to M at a position corresponding to position 550 of SEQ ID NO: 2, a substitution to P at a position corresponding to position 573 of SEQ ID NO: 2, and a substitution to K at a position corresponding to position 580 of SEQ ID NO: 2.

25. The method of claim 11, wherein said variant of albumin, fragment thereof or fusion polypeptides comprising said variant albumin or fragment thereof comprises a substitution to K at a position corresponding to position 550 of SEQ ID NO: 2, a substitution to P at a position corresponding to position 573 of SEQ ID NO: 2, and a substitution to K at a position corresponding to position 580 of SEQ ID NO: 2.

* * * * *